(12) United States Patent
Lynch et al.

(10) Patent No.: US 11,408,013 B2
(45) Date of Patent: *Aug. 9, 2022

(54) MICROORGANISMS AND METHODS FOR THE PRODUCTION OF FATTY ACIDS AND FATTY ACID DERIVED PRODUCTS

(71) Applicant: CARGILL, INCORPORATED, Wayzata, MN (US)

(72) Inventors: Michael Lynch, Durham, NC (US); Michael Louie, Broomfield, CO (US); Shelley Copley, Boulder, CO (US); Eileen Spindler, Lafayette, CO (US); Brittany Robinson, Wheat Ridge, CO (US); Matthew Lipscomb, Boulder, CO (US); Tanya Lipscomb-Warnecke, Boulder, CO (US); Hans Liao, Superior, CO (US); David Hogsett, Niwot, CO (US); Ron Evans, Louisville, CO (US)

(73) Assignee: CARGILL, INCORPORATED, Wayzata, MN (US)

( * ) Notice: Subject to any disclaimer, the term of this patent is extended or adjusted under 35 U.S.C. 154(b) by 259 days.

This patent is subject to a terminal disclaimer.

(21) Appl. No.: 16/453,323

(22) Filed: Jun. 26, 2019

(65) Prior Publication Data

US 2020/0048666 A1    Feb. 13, 2020

Related U.S. Application Data

(63) Continuation of application No. 14/904,862, filed as application No. PCT/US2014/047320 on Jul. 18, 2014, now Pat. No. 10,337,038.

(60) Provisional application No. 61/856,652, filed on Jul. 19, 2013.

(51) Int. Cl.

| | |
|---|---|
| *C12P 7/64* | (2006.01) |
| *C12N 1/20* | (2006.01) |
| *C12N 9/10* | (2006.01) |
| *C12N 9/04* | (2006.01) |
| *C12N 9/02* | (2006.01) |
| *C12N 9/88* | (2006.01) |
| *C12P 7/6409* | (2022.01) |

(52) U.S. Cl.
CPC .............. *C12P 7/6409* (2013.01); *C12N 1/20* (2013.01); *C12N 9/001* (2013.01); *C12N 9/0006* (2013.01); *C12N 9/1029* (2013.01); *C12N 9/88* (2013.01); *C12Y 101/01035* (2013.01); *C12Y 103/01093* (2015.07); *C12Y 203/01194* (2013.01); *C12Y 402/01059* (2013.01)

(58) Field of Classification Search
CPC .......... C12N 9/88; C12N 1/20; C12N 9/0006; C12N 15/52; C12N 9/001; C12N 9/1029; C12Y 101/01035; C12Y 203/01194; C12Y 402/01059; C12Y 103/01093; C12P 7/6409

See application file for complete search history.

(56) References Cited

U.S. PATENT DOCUMENTS

| | | |
|---|---|---|
| 2,408,889 A | 8/1946 | Short |
| 2,464,768 A | 3/1949 | Redmon |
| 2,469,701 A | 5/1949 | Redmon |
| 2,798,053 A | 7/1957 | Brown |
| 3,687,885 A | 8/1972 | Abriss |
| 3,872,037 A | 3/1975 | MacLeod |
| 3,875,101 A | 4/1975 | MacLeod |
| 3,891,591 A | 6/1975 | Chang |
| 3,904,685 A | 9/1975 | Shahidi |
| 3,915,921 A | 10/1975 | Schlatzer, Jr. |
| 4,029,577 A | 6/1977 | Godlewski |
| 4,266,641 A | 5/1981 | Sunohara |
| 4,268,641 A | 5/1981 | Koenig |
| 4,301,266 A | 11/1981 | Muenster |
| 4,431,547 A | 2/1984 | Dubin |
| 4,666,983 A | 5/1987 | Tsubakimoto |
| 4,685,915 A | 8/1987 | Hasse |
| 4,708,997 A | 11/1987 | Stanley, Jr. |
| 4,734,478 A | 3/1988 | Tsubakimoto |
| 4,857,610 A | 8/1989 | Chmelir |
| 4,952,505 A | 8/1990 | Cho |
| 4,985,518 A | 1/1991 | Alexander |
| 5,009,653 A | 4/1991 | Osborn, III |
| 5,093,472 A | 3/1992 | Bresciani |
| 5,135,677 A | 8/1992 | Yamaguchi |
| 5,145,906 A | 9/1992 | Chambers |

(Continued)

FOREIGN PATENT DOCUMENTS

| | | |
|---|---|---|
| CA | 2520795 A | 10/2004 |
| CA | 2591599 A | 7/2006 |

(Continued)

OTHER PUBLICATIONS

Okamura et al. Unprecedented acetoacetyl-coenzyme A synthesizing enzyme of the thiolase superfamily involved in the mevalonate pathway. PNAS (2010), 107(25), 11265-11270. (Year: 2010).*

(Continued)

*Primary Examiner* — Sean C. Barron

(57) ABSTRACT

This invention relates to metabolically engineered microorganism strains, such as bacterial strains, in which there is an increased utilization of malonyl-CoA for production of a fatty acid or fatty acid derived product, wherein the modified microorganism produces fatty acyl-CoA intermediates via a malonyl-CoA dependent but malonyl-ACP independent mechanism.

18 Claims, 27 Drawing Sheets

Specification includes a Sequence Listing.

(56) References Cited

U.S. PATENT DOCUMENTS

| | | |
|---|---|---|
| 5,180,798 A | 1/1993 | Nakamura |
| 5,252,474 A | 10/1993 | Gewain |
| 5,274,073 A | 12/1993 | Gruber |
| 5,331,059 A | 7/1994 | Engelhardt |
| 5,342,899 A | 8/1994 | Graham |
| 5,350,799 A | 9/1994 | Woodrum |
| 5,426,199 A | 6/1995 | Lundquist |
| 5,470,928 A | 11/1995 | Harwood |
| 5,487,989 A | 1/1996 | Fowler |
| 5,510,307 A | 4/1996 | Narayanan |
| 5,510,526 A | 4/1996 | Baniel |
| 5,558,656 A | 9/1996 | Bergman |
| 5,616,496 A | 4/1997 | Frost |
| 5,723,639 A | 3/1998 | Datta |
| 5,817,870 A | 10/1998 | Haas |
| 5,827,255 A | 10/1998 | Crainic |
| 5,876,983 A | 3/1999 | Sugimoto |
| 6,004,773 A | 12/1999 | Araki |
| 6,013,494 A | 1/2000 | Nakamura |
| 6,087,140 A | 7/2000 | Cameron |
| 6,117,658 A | 9/2000 | Dennis |
| 6,143,538 A | 11/2000 | Somerville |
| 6,284,495 B1 | 9/2001 | Sato |
| 6,297,319 B1 | 10/2001 | Nagasuna |
| 6,306,636 B1 | 10/2001 | Haselkorn |
| 6,355,412 B1 | 3/2002 | Stewart |
| 6,472,188 B1 | 10/2002 | Lee |
| 6,489,508 B1 | 12/2002 | Van Gansbeghe |
| 6,509,156 B1 | 1/2003 | Stewart |
| 6,534,679 B2 | 3/2003 | Eyal |
| 6,586,229 B1 | 7/2003 | Ben-Bassat |
| 6,593,116 B1 | 7/2003 | Huisman |
| 6,623,944 B2 | 9/2003 | Rieping |
| 6,709,919 B2 | 3/2004 | Tu |
| 6,723,799 B2 | 4/2004 | Sun |
| 6,852,517 B1 | 2/2005 | Suthers |
| 6,960,455 B2 | 11/2005 | Livshits |
| 7,090,998 B2 | 8/2006 | Ishikawa |
| 7,118,896 B2 | 10/2006 | Kalscheuer |
| 7,141,154 B2 | 11/2006 | Lin |
| 7,153,663 B2 | 12/2006 | Payne |
| 7,166,743 B2 | 1/2007 | Zhong |
| 7,186,541 B2 | 3/2007 | Gokarn |
| 7,186,856 B2 | 3/2007 | Meng |
| 7,223,567 B2 | 5/2007 | Ka-Yiu |
| 7,279,598 B2 | 10/2007 | Meng |
| 7,285,406 B2 | 10/2007 | Payne |
| 7,309,597 B2 | 12/2007 | Liao |
| 7,326,557 B2 | 2/2008 | San |
| 7,358,071 B2 | 4/2008 | Payne |
| 7,393,676 B2 | 7/2008 | Gokarn |
| 7,524,660 B2 | 4/2009 | Caimi |
| 7,538,247 B2 | 5/2009 | Craciun |
| 7,638,316 B2 | 12/2009 | Gokarn |
| 7,678,869 B2 | 3/2010 | Matyjaszewski |
| 7,687,661 B2 | 3/2010 | Lilga |
| 7,803,620 B2 | 9/2010 | Weaver |
| 7,826,975 B2 | 11/2010 | Maranas |
| 7,833,761 B2 | 11/2010 | Terashita |
| 7,846,688 B2 | 12/2010 | Gill |
| 7,943,362 B2 | 5/2011 | Frost |
| 7,987,056 B2 | 7/2011 | Gill |
| 8,048,624 B1 | 11/2011 | Lynch |
| 8,076,111 B2 | 12/2011 | Fukui |
| 8,097,439 B2 | 1/2012 | Alibhai |
| 8,110,093 B2 | 2/2012 | Friedman |
| 8,110,670 B2 | 2/2012 | Hu |
| 8,183,028 B2 | 5/2012 | Alibhai |
| 8,268,599 B2 | 9/2012 | Schirmer |
| 8,283,143 B2 | 10/2012 | Hu |
| 8,313,934 B2 | 11/2012 | Bhatia |
| 8,323,924 B2 | 12/2012 | Schirmer |
| 8,372,610 B2 | 2/2013 | Lee |
| 8,377,666 B2 | 2/2013 | Haselbeck |
| 8,467,975 B2 | 6/2013 | Ryan T |
| 8,530,221 B2 | 9/2013 | Hu |
| 8,535,916 B2 | 9/2013 | Del Cardayre |
| 8,597,922 B2 | 12/2013 | Alibhai |
| 8,652,816 B2 | 2/2014 | Lynch |
| 8,658,404 B2 | 2/2014 | Schirmer |
| 8,753,840 B2 | 6/2014 | Vermaas |
| 8,809,027 B1 | 8/2014 | Lynch |
| 8,835,137 B2 | 9/2014 | Roberts |
| 8,859,259 B2 | 10/2014 | Rude |
| 8,883,464 B2 | 11/2014 | Lynch |
| 9,388,419 B2 | 7/2016 | Lynch |
| 9,428,778 B2 | 8/2016 | Lynch |
| 9,447,438 B2 | 9/2016 | Liao |
| 9,587,231 B2* | 3/2017 | Hom |
| 10,337,038 B2* | 7/2019 | Lynch .................... C12N 9/88 |
| 2002/0081684 A1 | 6/2002 | Grobler |
| 2002/0164729 A1 | 11/2002 | Skraly |
| 2003/0004375 A1 | 1/2003 | Mizrahi |
| 2003/0087381 A1 | 5/2003 | Gokarn |
| 2003/0101486 A1 | 5/2003 | Facciotti |
| 2003/0158441 A1 | 8/2003 | Zhong |
| 2003/0159175 A1 | 8/2003 | Ghulam Kadir |
| 2003/0191146 A1 | 10/2003 | Kabbash |
| 2003/0211131 A1 | 11/2003 | Martin |
| 2003/0233675 A1 | 12/2003 | Cao |
| 2003/0235892 A1 | 12/2003 | Katz |
| 2004/0009466 A1 | 1/2004 | Maranas |
| 2004/0076982 A1 | 4/2004 | Gokarn |
| 2004/0077090 A1 | 4/2004 | Short |
| 2004/0152159 A1 | 8/2004 | Causey |
| 2004/0152174 A1 | 8/2004 | Cervin |
| 2004/0209337 A1 | 10/2004 | Frost |
| 2004/0210087 A1 | 10/2004 | Meng |
| 2004/0214294 A1 | 10/2004 | Rieping |
| 2005/0003481 A1 | 1/2005 | Gabriel |
| 2005/0054060 A1 | 3/2005 | Chateau |
| 2005/0196758 A1 | 9/2005 | Rock |
| 2005/0221457 A1 | 10/2005 | Tsobanakis |
| 2005/0221466 A1 | 10/2005 | Liao |
| 2005/0222458 A1 | 10/2005 | Craciun |
| 2005/0233031 A1 | 10/2005 | Hughes |
| 2005/0239179 A1 | 10/2005 | Skraly |
| 2005/0272135 A1 | 12/2005 | Datta |
| 2005/0283029 A1 | 12/2005 | Meng |
| 2006/0014977 A1 | 1/2006 | Miller |
| 2006/0068468 A1 | 3/2006 | Knopf |
| 2006/0084098 A1 | 4/2006 | Gill |
| 2006/0166342 A1 | 7/2006 | Taoka |
| 2007/0010708 A1 | 1/2007 | Ness |
| 2007/0027342 A1 | 2/2007 | Meng |
| 2007/0031918 A1 | 2/2007 | Dunson, Jr. |
| 2007/0087403 A1 | 4/2007 | Bestel-Corre |
| 2007/0092957 A1 | 4/2007 | Donaldson |
| 2007/0107080 A1 | 5/2007 | Liao |
| 2007/0141574 A1 | 6/2007 | Keasling |
| 2007/0148749 A1 | 6/2007 | Yasuda |
| 2007/0184524 A1 | 8/2007 | Gokarn |
| 2007/0219390 A1 | 9/2007 | Zacher |
| 2007/0245431 A1 | 10/2007 | Metz |
| 2007/0270494 A1 | 11/2007 | Metz |
| 2007/0281343 A9 | 12/2007 | Arslanian |
| 2008/0076167 A1 | 3/2008 | Gokarn |
| 2008/0124785 A1 | 5/2008 | Liao |
| 2008/0182308 A1 | 7/2008 | Donaldson |
| 2008/0193989 A1 | 8/2008 | Verser |
| 2008/0199926 A1 | 8/2008 | Burgard |
| 2008/0274523 A1 | 11/2008 | Renninger |
| 2009/0017514 A1 | 1/2009 | Datta |
| 2009/0023006 A1 | 1/2009 | Bub |
| 2009/0031453 A1 | 1/2009 | Jessen |
| 2009/0053783 A1 | 2/2009 | Gokarn |
| 2009/0076297 A1 | 3/2009 | Bogan, Jr. |
| 2009/0082286 A1 | 3/2009 | Huang |
| 2009/0111151 A1 | 4/2009 | Julien |
| 2009/0148914 A1 | 6/2009 | Causey |
| 2009/0203097 A1 | 8/2009 | Flint |
| 2009/0234146 A1 | 9/2009 | Cooney |
| 2009/0246141 A1 | 10/2009 | Hirai |
| 2009/0291480 A1 | 11/2009 | Jessen |

(56) References Cited

U.S. PATENT DOCUMENTS

| | | |
|---|---|---|
| 2009/0298144 A1 | 12/2009 | Tsobanakis |
| 2009/0305369 A1 | 12/2009 | Donaldson |
| 2009/0325248 A1 | 12/2009 | Marx |
| 2010/0021978 A1 | 1/2010 | Burk |
| 2010/0028962 A1 | 2/2010 | Hu |
| 2010/0037329 A1 | 2/2010 | Frommer |
| 2010/0064381 A1 | 3/2010 | Zou |
| 2010/0068773 A1 | 3/2010 | Marx |
| 2010/0099910 A1 | 4/2010 | Meng |
| 2010/0113822 A1 | 5/2010 | Craciun |
| 2010/0151536 A1 | 6/2010 | Baynes |
| 2010/0170148 A1 | 7/2010 | Steen |
| 2010/0186117 A1 | 7/2010 | Fabijanski |
| 2010/0210017 A1 | 8/2010 | Gill |
| 2010/0257777 A1 | 10/2010 | Sanchez-Riera |
| 2010/0257778 A1 | 10/2010 | Gaertner |
| 2010/0261239 A1 | 10/2010 | Soucaille |
| 2010/0274033 A1 | 10/2010 | Sanchez-Riera |
| 2010/0285549 A1* | 11/2010 | Muramatsu .......... C12N 9/0004 435/160 |
| 2010/0291644 A1 | 11/2010 | Marx |
| 2011/0020883 A1 | 1/2011 | Roessler |
| 2011/0038364 A1 | 2/2011 | Monsieux |
| 2011/0072714 A1 | 3/2011 | Gaertner |
| 2011/0089016 A1 | 4/2011 | Winkelaar |
| 2011/0124063 A1 | 5/2011 | Lynch |
| 2011/0125118 A1 | 5/2011 | Lynch |
| 2011/0144377 A1 | 6/2011 | Eliot |
| 2011/0159558 A1 | 6/2011 | Grady |
| 2011/0162259 A1 | 7/2011 | Gaertner |
| 2011/0171702 A1 | 7/2011 | Reinecke |
| 2011/0183382 A1 | 7/2011 | Schmalisch |
| 2011/0183388 A1 | 7/2011 | Sabirova |
| 2011/0183391 A1 | 7/2011 | Frost |
| 2011/0190513 A1 | 8/2011 | Lynch |
| 2011/0214979 A1 | 9/2011 | Chen |
| 2011/0244575 A1 | 10/2011 | Lipscomb |
| 2011/0275851 A1 | 11/2011 | Orjuela |
| 2011/0281314 A1 | 11/2011 | Lynch |
| 2012/0041232 A1 | 2/2012 | Lynch |
| 2012/0058530 A1 | 3/2012 | Zhang |
| 2012/0116108 A1 | 5/2012 | Basu |
| 2012/0129231 A1 | 5/2012 | Wang |
| 2012/0135481 A1 | 5/2012 | Jessen |
| 2012/0240289 A1 | 9/2012 | Feussner |
| 2012/0244586 A1 | 9/2012 | Gokarn |
| 2012/0244588 A1 | 9/2012 | Park |
| 2012/0264902 A1 | 10/2012 | Lipscomb |
| 2012/0329110 A1 | 12/2012 | Kim |
| 2013/0071893 A1 | 3/2013 | Lynch |
| 2013/0078684 A1 | 3/2013 | Holtzapple |
| 2013/0078686 A1 | 3/2013 | Holtzapple |
| 2013/0122541 A1 | 5/2013 | Lynch |
| 2013/0122562 A1 | 5/2013 | Aldor |
| 2013/0189787 A1 | 7/2013 | Lynch |
| 2013/0316413 A1 | 11/2013 | Gonzalez |
| 2013/0345470 A1 | 12/2013 | Tengler |
| 2014/0051136 A1 | 2/2014 | Liao |
| 2014/0121118 A1 | 5/2014 | Warner |
| 2014/0135526 A1 | 5/2014 | Lynch |
| 2014/0215904 A1 | 8/2014 | Pandey |
| 2014/0242648 A1 | 8/2014 | Ochiai |
| 2014/0309451 A1 | 10/2014 | Tengler |
| 2014/0330032 A1 | 11/2014 | Lynch |
| 2015/0044746 A1 | 2/2015 | Meerman |
| 2015/0056651 A1 | 2/2015 | Lynch |
| 2015/0056669 A1 | 2/2015 | Liao |
| 2015/0056684 A1 | 2/2015 | Lipscomb |
| 2015/0057455 A1 | 2/2015 | Hoppe |
| 2015/0064754 A1 | 3/2015 | Liao |
| 2015/0072384 A1 | 3/2015 | Lynch |
| 2015/0072399 A1 | 3/2015 | Lynch |
| 2015/0119601 A1 | 4/2015 | Liao |
| 2015/0299679 A1 | 10/2015 | Shumaker |
| 2016/0060663 A1 | 3/2016 | Grammann |
| 2016/0090576 A1 | 3/2016 | Garg |
| 2016/0362710 A9 | 7/2016 | Lee |
| 2016/0257975 A1 | 9/2016 | Lynch |
| 2016/0340700 A1 | 11/2016 | Liao |

FOREIGN PATENT DOCUMENTS

| | | |
|---|---|---|
| CA | 2654133 A1 | 12/2007 |
| CN | 1301304 A | 6/2001 |
| CN | 101679924 B | 6/2013 |
| CN | 101573451 B | 4/2014 |
| CN | 103975070 A | 8/2014 |
| CN | 102869768 B | 11/2016 |
| DE | 102008002309 A1 | 12/2009 |
| EP | 1124789 B1 | 9/2004 |
| EP | 1036190 B1 | 5/2005 |
| EP | 1305439 B1 | 6/2006 |
| EP | 1124979 B1 | 8/2006 |
| EP | 1731604 A1 | 12/2006 |
| EP | 1105514 B1 | 2/2008 |
| EP | 1778840 B1 | 6/2008 |
| EP | 1654212 B1 | 7/2009 |
| EP | 1706457 B1 | 2/2012 |
| EP | 2594633 A1 | 5/2013 |
| EP | 2133420 B1 | 4/2014 |
| EP | 1975236 B1 | 5/2015 |
| EP | 3103867 B1 | 5/2018 |
| EP | 2993228 B1 | 10/2019 |
| GB | 2473755 B | 9/2011 |
| JP | 2010259388 A | 11/2010 |
| JP | 2011512848 A | 4/2011 |
| KR | 2007096348 | 10/2007 |
| KR | 20120108538 A | 10/2012 |
| WO | 9821339 W | 5/1998 |
| WO | 9855442 W | 12/1998 |
| WO | 9914343 W | 3/1999 |
| WO | 0039287 W | 7/2000 |
| WO | 0056693 W | 9/2000 |
| WO | 0061740 W | 10/2000 |
| WO | 0116346 W | 3/2001 |
| WO | 0138284 W | 5/2001 |
| WO | 0208428 W | 1/2002 |
| WO | 0234784 W | 5/2002 |
| WO | 0242418 W | 5/2002 |
| WO | 02090312 W | 11/2002 |
| WO | 03040690 W | 5/2003 |
| WO | 03062173 W | 7/2003 |
| WO | 03082795 W | 10/2003 |
| WO | 2004018621 A2 | 3/2004 |
| WO | 2004033646 A2 | 4/2004 |
| WO | 2005003074 A1 | 1/2005 |
| WO | 2005047498 A1 | 5/2005 |
| WO | 2005105770 A2 | 11/2005 |
| WO | 2005118719 A2 | 12/2005 |
| WO | 2006034156 A2 | 3/2006 |
| WO | 2006052871 A2 | 5/2006 |
| WO | 2006052914 A2 | 5/2006 |
| WO | 2006121755 A2 | 11/2006 |
| WO | 2007012078 A1 | 1/2007 |
| WO | 2007030830 A2 | 3/2007 |
| WO | 2007042494 A2 | 4/2007 |
| WO | 2007047680 A2 | 4/2007 |
| WO | 2007093848 A2 | 8/2007 |
| WO | 2007106903 A2 | 9/2007 |
| WO | 2007130745 A1 | 11/2007 |
| WO | 2007136762 A2 | 11/2007 |
| WO | 2008021765 A2 | 2/2008 |
| WO | 2008023039 A1 | 2/2008 |
| WO | 2008027742 A1 | 3/2008 |
| WO | 2008028002 A1 | 3/2008 |
| WO | 2008072920 A1 | 6/2008 |
| WO | 2008089102 A2 | 7/2008 |
| WO | 2008091627 A2 | 7/2008 |
| WO | 2008145737 A1 | 12/2008 |
| WO | 2008149951 A1 | 12/2008 |
| WO | 2009006430 A1 | 1/2009 |
| WO | 2009031737 A1 | 3/2009 |
| WO | 2009036095 A1 | 3/2009 |
| WO | 2009062190 A2 | 5/2009 |

(56) References Cited

FOREIGN PATENT DOCUMENTS

| | | |
|---|---|---|
| WO | 2009089457 A1 | 7/2009 |
| WO | 2009094485 A1 | 7/2009 |
| WO | 2009111513 A1 | 9/2009 |
| WO | 2009111672 A1 | 9/2009 |
| WO | 2009121066 A1 | 10/2009 |
| WO | 2009143401 A2 | 11/2009 |
| WO | 2009151342 A1 | 12/2009 |
| WO | 2009156469 A1 | 12/2009 |
| WO | 2010006076 A2 | 1/2010 |
| WO | 2010011874 A2 | 1/2010 |
| WO | 2010017230 A2 | 2/2010 |
| WO | 2010031083 A2 | 3/2010 |
| WO | 2010105095 A1 | 9/2010 |
| WO | 2011002892 A2 | 1/2011 |
| WO | 2011008565 A1 | 1/2011 |
| WO | 2011038364 A1 | 3/2011 |
| WO | 2011063304 A1 | 5/2011 |
| WO | 2011063363 A2 | 5/2011 |
| WO | 2011094457 A1 | 8/2011 |
| WO | 2012017083 A1 | 2/2012 |
| WO | 2012019175 A2 | 2/2012 |
| WO | 2012050931 A2 | 4/2012 |
| WO | 2012054400 A1 | 4/2012 |
| WO | 2012129450 A1 | 9/2012 |
| WO | 2012135760 A1 | 10/2012 |
| WO | 2012177726 A1 | 12/2012 |
| WO | 2013003608 A1 | 1/2013 |
| WO | 2013019647 A1 | 2/2013 |
| WO | 2013039563 A1 | 3/2013 |
| WO | 2013048557 A1 | 4/2013 |
| WO | 2013126855 A1 | 8/2013 |
| WO | 2013152051 A2 | 10/2013 |
| WO | 2013152052 A2 | 10/2013 |
| WO | 2013192450 A1 | 12/2013 |
| WO | 2013192451 A1 | 12/2013 |
| WO | 2013192453 A1 | 12/2013 |
| WO | 2014026162 A1 | 2/2014 |
| WO | 2014042693 A1 | 3/2014 |
| WO | 2014145096 A1 | 9/2014 |
| WO | 2014145297 A1 | 9/2014 |
| WO | 2014145332 A1 | 9/2014 |
| WO | 2014145334 A1 | 9/2014 |
| WO | 2014145343 A1 | 9/2014 |
| WO | 2014145344 A2 | 9/2014 |
| WO | 2014146026 A1 | 9/2014 |
| WO | 2014146047 A1 | 9/2014 |
| WO | 2014198831 A1 | 12/2014 |
| WO | 2015010103 A2 | 1/2015 |
| WO | 2015042626 A1 | 4/2015 |

OTHER PUBLICATIONS

Musayev et al. Crystal Structure of a Substrate Complex of *Mycobacterium tuberculosis* b-Ketoacyl-acyl Carrier Protein Synthase III (FabH) with Lauroyl-coenzyme AJ. Mol. Biol. (2005), 346, 1313-1321. (Year: 2005).*
Kiatpapan, Pornpimon , et al., "Molecular Characterization of Lactobacillus plantarum Genes for B-Ketoacyl-Acyl Carrier Protein Synthase III (fabH) and Acetyl Coenzyme A Carboxylase (accBCDA), Which Are Essential for Fatty Acid Biosynthesis", Appl Environ Microbiol. 67(1), Jan. 2001, 426-33.
Kim , et al., "Effect of Overexpression of Actinobacillus succinogenes Phosphoenolpyruvate Carboxykinase on Succinate Production in *Escherichia coli*", Appl. Environ. Microbiol, vol. 70 No. 2, Feb. 2004, 1238-1241.
Kim, Joong Kyun, et al., "Extractive Recovery of Products from Fermentation Broths", Biotechnol. Bioprocess Eng, 4,1999, 1-11.
Kim, Kwang-Seo , et al., "The Rut Pathway for Pyrimidine Degradation: Novel Chemistry and Toxicity Problems", J Bacteriol. 192(16), Aug. 2010, 4089-102.
Kim, Youngnyun , et al., "Construction of an *Escherichia coli* K-12 Mutant for Homoethanologenic Fermentation of Glucose or Xylose without Foreign Genes", Appl Environ Microbiol 73(6), Mar. 2007, 1766-71.
Kim, Youngnyun , et al., "Dihydrolipoamide Dehydrogenase Mutation Alters the NADH Sensitivity of Pyruvate Dehydrogenase Complex of *Escherichia coli* K-12", J Bacteriol. 190(11), Jun. 2008, 3851-8.
Kimchi-Sarfaty , et al., "A "Silent" Polymorphism in the MDR1 Gene Changes Substrate Specificity", Science. Science 315(5811):, Jan. 26, 2007, 525-8.
KINNEY. Manipulating flux through plant metabolic pathways. Curr Opinion Plant Biol. Apr. 1998; 1(2): 173-8.
KISSELEV , "Polypeptide Release Factors in Prokaryotes and Eukaryotes: Same Function, Different Structure", Structure. 10(1), Jan. 2002, 8-9.
Kizer, Lance , et al., "Application of Functional Genomics to Pathway Optimization for Increased Isoprenoid Production", Appl Environ Microbiol. 74(10), May 2008, 3229-41.
Kleerebezem , et al., "Controlled gene expression systems for lactic acid bacteria: transferable nisin-inducible expression cassettes for *Lactococcus, Leuconostoc*, and *Lactobacillus* spp", Appl Environ Microbiol. Nov. 1997;63 (11):4581-4584.
Kleerebezem , et al., "The qmeA (ts) mutation of *Escherichia coli* is localized in the fabI gene, which encodes enoyl-ACP reductase.", Res Microbiol. 147(8), Oct. 1996, 609-13.
Knothe, Gerhard , et al., "Biodiesel and renewable diesel: A comparison", Progress in Energy and Combustion Science. vol. 36, No. 3 XP026919218, Jun. 1, 2010, 364-373.
Kozliak , et al., "Expression of proteins encoded by the *Escherichia coli* cyn operon: carbon dioxide-enhanced degradation of carbonic anhydrase", J Bacteriol. 176(18), Sep. 1994, 5711-7.
Kozliak, et al., "Role of bicarbonate/CO2 in the inhibition of *Escherichia coli* growth by cyanate", J. Bacteriol. vol. 177 No. 11, Jun. 1995, 3213-3219.
Kroeger, Jasmin K., et al., "A spectrophotometric assay for measuring acetyl-coenzyme A carboxylase", Anal Biochem. 411(1), Apr. 1, 2011, 100-5.
Kunin, et al. A comparative analysis of the inventive step standard in the European and Japanese patent office from an US perspective. IP Litigator. Jan./Feb. 2008; 15-23.
Kurcok , et al., "Reactions of13-lactones with potassium alkoxides and their complexes with 18-crown-6 in aprotic solvents", Journal of Organic Chemistry. 58(16), 1993, 4219-4220.
Kwon , et al., "A physiology study of *Escherichia coli* overexpressing phosphoenolpyruvate carboxykinase", Biosci. Biotechnol. Biochem., 72 (4), 2008, 1138-1141.
Kwon , et al., "Influence of gluconeogenic phosphoenolpyruvate carboxykinase (PCK) expression on succinic acid fermentation in *Escherichia coli* under high bicarbonate condition", Journal of Microbiology and Biotechnology 16(9)., Sep. 2006 , 1448-1452.
Lambert , et al., "Cre-lox-Based System for Multiple Gene Deletions and Selectable-Marker Removal in Lactobacillus plantarum", AEM, vol. 73, No. 4, Jan. 1, 1900, 1126-1135.
Lan, El e Liao, JC "ATP drives direct photosynthetic production of 1-butanol in cyanobacteria", Proceedings of the National Academy of Sciences, vol. 109, No. 16, ISSN 0027-8424, pp. 6018-6023.
Lan, El e LIAO, JC "Microbial synthesis of n-butanol, isobutanol, and other higher alcohols from diverse resources", Bioresource Technology, , vol. 135, ISSN 0960-8524, pp. 339-349.
Langlois , et al., "A new preparation of trifluoromethanesulfinate salts", Journal of Fluorine Chemistry. 128(7), 2007, 851-856.
Lardizabal, KD et al., "Purification of a Jojoba Embryo Wax Synthase, Cloning of Its CDNA, and Production of High Levels of Wax in Seeds of Transgenic *Arabidopsis*", Plant Physiology, vol. 122, No. 3, ISSN 0032-0889, pp. 645-655.
Lassner, Michael W., et al., "Lysophosphatidic Acid Acyltransferase from Meadowfoam Mediates Insertion of Erucic Acid at the sn-2 Position of Triacylglycerol in Transgenic Rapeseed Oil", Plant Physiol. 109(4), Dec. 1995, 1389-94.
Lee, et al. Fatty acid synthesis by elongases in trypanosomes. Cell. Aug. 25, 2006;126(4):691-9.
Lee, S et al., "Correlations between FAS elongation cycle genes expression and fatty acid production for improvement of long-chain

(56) References Cited

OTHER PUBLICATIONS fatty acids in *Escherichia coli*", Applied Biochemistry and Biotechnology, vol. 169, No. 5, ISSN 1559-0291, pp. 1606-1619.
Leeper, Stephen A., "Membrane Separations in the Recovery of Biofuels and Biochemicals: An Update Review", Separation and Purification Technology, Norman N. Li and Joseph M. Calo, Eds., Marcel Dekker, 1992, 99-194.
Lennen, et al., "A process for microbial hydrocarbon synthesis: Overproduction of fatty acids in *Escherichia coli* and catalytic conversion to alkanes", Biotechnol Bioeng. vol. 106, Issue 2, Jun. 1, 2010, 193-202.
Lennen, RM e Pfleger, BF "Engineering *Escherichia coli* to synthesize free fatty acids", Trends in Biotechnology, vol. 30, No. 12, ISSN 0167-7799, pp. 659-667.
Lennen, RM et al., "Microbial production of fatty acid-derived fuels and chemicals", Current Opinion in Biotechnology., vol. 24, No. 6, ISSN 0958-1669, pp. 1044-1053 Epub Mar. 28, 2013.
Leonard, Effendi, et al., "Engineering Central Metabolic Pathways for High-Level Flavonoid Production in *Escherichia coli*", Appl Environ Microbiol. 73(12), Jun. 2007, 3877-86.
Li, et al., "Effect of poxB gene knockout on metabolism in *Escherichia coli* based on growth characteristics and enzyme activities", World Journal of Microbiology and Biotechnology vol. 23, Issue 4, Apr. 2007, 573-580.
Li, Jianguo, et al., "Chronic intermittent hypoxia upregulates genes of lipid biosynthesis in obese mice", J Appl Physiol. 99(5), Nov. 2005,1643-8.
Li, Wang, et al., "Characterization of two temperature-inducible promoters newly isolated from B. subtilis", Biochem Biophys Res Commun. 358(4), Jul. 13, 2007, 1148-53.
Liang, et al., "Fe2(SO4)3.4H20/concentrated H2SO4: an efficient catalyst for esterification", Journal of Chemical Research, Synopses. 3, 2004, 226-227.
Lilly, Mariska, et al., "The effect of increased yeast alcohol acetyltransferase and esterase activity on the flavour profiles of wine and distillates", Yeast. 23(9), Jul. 15, 2006, 641-59.
Lioa, et al., "Metabolic engineering for a malonyl-CoA-dependent pathway for fatty acid production in *Escherichia coli* (abstract)", SIMB Annual Meeting & Exhibition. Aug. 12-16, 2012. Washington Hilton, Washington, DC. Available at http://sim.confex.com/sim/2012/webprogram/Paper23197.html, Aug. 2012.
Lipscomb, et al., "Poster—Understanding production of 3-Hydroxypropionic Acid (3¬HP) in a genomic context.", OPX Biotechnologies. Metabolic Engineering, Sep. 17, 2008.
Lu, Xuefeng, et al., "Overproduction of free fatty acids in *E. coli*: Implications for biodiesel production", Metab Eng. 10(6), Nov. 2008, 333-9.
Lutke-Eversloh, et al., "Feedback inhibition of chorismate mutase/prephenate dehydrogenase (TyrA) of *Escherichia coli*: generation and characterization of tyrosine-insensitive mutants", Appl Environ Microbiol, vol. 71 No. 11, Nov. 2005, 7224-8.
Lynch, "Rapid optimization of microorganisms for the cost superior production of chemicals & fuels", OPX Biotechnologies, Sep. 15, 2008.
Lynch, M., et al., "SCALEs: multiscale analysis of library enrichment. Nat Methods", Nat Methods. 4(1)., Jan. 2007, 87-93.
Machado, et al., "A selection platform for carbon chain elongation using the CoA-dependent pathway to produce inear higher alcohols", Metabolic Eng. 2012, 14, 504-11.
Magnuson, Kelly, et al., "Regulation of fatty acid biosynthesis in *Escherichia coli*", Microbiological Reviews, vol. 57, No. 3, 1993, 522-542.
Mandaokar, Ajin, et al., "Transcriptional regulators of stamen development in *Arabidopsis* identified by transcriptional profiling", Plant J. 46(6), Jun. 2006, 984-1008.
Martin, et al., "Engineering a mevalonate pathway in *Escherichia coli* for production of terpenoids", Nat Biotechnol. 21(7)., Jul. 2003, 796-802.

Masayuki, et al., "Expression of Clostridium acetobutylicum butanol synthetic genes in *Escherichia coli*", Applied Microbiology and Biotechnology, Jan. 2008, vol. 77, Issue 6, pp. 1305-1316.
McCabe, Warren L., et al., "Unit Operations of Chemical Engineering", 5th Ed., W.L. McGraw Hill, New York, 1993.
Singh, et al., "Genes restoring redox balance in fermentation-deficient *E. coli* NZN111", Metabolic Engineering. vol. 11, Issue 6, Nov. 2009, 347-354.
Singh, Raushan Kumar, et al., "Protein Engineering Approaches in the Post-Genomic Era", Curr Protein Pept Sci. 18, 2017, 1-11.
Skerra, Arne, "Use of the tetracycline promoter for the tightly regulated production of a murine antibody fragment in *Escherichia coli*", Gene. 151(1-2), Dec. 30, 1994, 131-5.
Smirnova, N et al., Engineered Fatty Acid Biosynthesis by Altered Catalytic Function of b-Ketoacyl-Acyl Carrier Protein Synthase III. Journal of Bacteriology, Apr. 2001, vol. 183, No. 7, pp. 2335-2342.
Sousa, Silvino, et al., "The ARO4 gene of Candida albicans encodes a tyrosine-sensitive DAHP synthase evolution, functional conservation and phenotype of Aro3p-, Aro4p-deficient mutants", Microbiology 148(Pt5), 2002, 1291-1303.
Stephanie C. Weatherly, "Expression and characterization of recombinant fungal acetyl-CoA carboxylase and isolation of a soraphen-binding domain", Biochemical Journal, GB, (May 15, 2004), vol. 380, No. 1, doi:10.1042/bj20031960, ISSN 0264-6021, pp. 105-110, XP055302533, May 15, 2004.
Stephanopoulos, et al., "Challenges in engineering microbes for biofuels production", Science. 315(5813), Feb. 9, 2007, 801-4.
Stephanopoulos, et al., "Network Rigidity And Metabolic Engineering In Metabolite Overproduction", Science. 252(5013), Jun. 21, 1991, 1675-81.
Stephens, et al., "Mitochondrial fatty acid synthesis in Trypanosoma brucei", Journal of Biological Chemistry, vol. 282, No. 7, Feb. 16, 2007, 4427-36.
Stim, et al., "Nucleotide sequence of the adi gene, which encodes the biodegradative acid-induced arginine decarboxylase of *Escherichia coli*", J Bacteriol. 175(5), Mar. 1993, 1221-34.
Stone, Scot J., et al., "Lipids and Lipoproteins: Lipopenia and Skin Barrier Abnormalities in DGAT2-deficient Mice", J Biol Chem. 279(12), Mar. 19, 2004, 11767-76.
Straathoff, et al., "Feasibility of acrylic acid production by fermentation", Appl Microbiol Biotechnol.67(6), Jun. 2005, 727-34.
Strauss, et al., "Enzymes of a novel autotrophic CO2 fixation pathway in the phototrophic bacterium Chloroflexus aurantiacus, the 3-hydroxypropionate cycle", Eur J Biochem. 215(3), Aug. 1, 1993, 633-43.
STRYER. Biochemistry 4th Ed. Freeman and Co., New York. 1995; 463-650.
Studier, William F., et al., "Use of Bacteriophage T7 RNA Polymerase to Direct Selective High-level Expression of Cloned Genes", J Mol Biol. 189(1), May 5, 1900, 113-30.
Subrahmanyam, Satyanarayana, et al., "Overproduction of a Functional Fatty Acid Biosynthetic Enzyme Blocks Fatty Acid Synthesis in *Escherichia coli*", J Bacteriol. 180(17), Sep. 1998, 4596-602.
Suh, et al. Cuticular lipid composition, surface structure, and gene expression in *Arabidopsis* stem epidermis. Plant Physiol. Dec. 2005; 139(4):1649-65. Epub Nov. 18, 2005.
Sulter, G. J., et al., "Proliferation and metabolic significance of peroxisomes in Candida boidinii during growth on D-alanine or oleic acid as the sole carbon source", Arch Microbiol. 153(5), 1990, 485-9.
Sun, et al., "ZrOC12 x 8H20: an efficient, cheap and reusable catalyst for the esterification of acrylic acid and other carboxylic acids with equimolar amounts of alcohols", Molecules. 11(4):, Apr. 10, 2006, 263-71.
Taghavi, et al., "Electroporation of Alcaligenes eutrophus with (mega) plasmids and genomic DNA fragments", Appl Environ Microbiol. Oct. 1994; 60(10): 3585-3591.
Takamizawa, et al., "Beta-Hydroxypropionic Acid Production By Byssochlamys Sp. Grown On Acrylic Acid", Appl Microbiol Biotechnol. 40, 1993, 196-200.

(56) References Cited

OTHER PUBLICATIONS

Takamura, et al., "Changes in the intracellular concentration of acetyl-CoA and malonyl-CoA in relation to the carbon and energy metabolism of Escherichia coli K12", J Gen Microbiol. 134(8), Aug. 1988, 2249-53.
Tanimoto, et al., "Analysis of the Conjugal Transfer System of the Pheromone-Independent Highly Transferable Enterococcus Plasmid pMG1: Identification of a tra Gene (traA) Up-Regulated during Conjugation", doi: 10.1128/JB 184.20.5800-5804.2002 J. Bacteriol. Oct. 2002 vol. 184 No. 20 5800-5804.
Tian, et al., "Mycobacterium tuberculosis appears to lack an alpha-ketoglutarate dehydrogenase and encodes pyruvate dehydrogenase in widely separated genes", Mol Microbiol. 57(3), Aug. 2005, 859-68.
Tian, et al., "Variant tricarboxylic acid cycle in Mycobacterium tuberculosis: Identification of alpha-ketoglutarate decarboxylase". Proc Natl Acad Sci U S A. 102(30), Jul. 26, 2005,10670-5.
Tomar, A., "Master Thesis. Production of Pyruvate by Escherichia coli Using Metabolic Engineering", The University of Georgia, May 2002, 1-171.
Tunnicliff, et al., "The inhibition by substrate analogues of gamma-aminobutyrate aminotransferase from mitochondria of different subcellular fractions of rat brain", Can J Biochem. 55(4), Apr. 1977, 479-84.
Turlin, et al., "3-phenylpropionate catabolism and the Escherichia coli oxidative stress response", Res Microbiol. 156(3), Apr. 2005, 312-21.
UniProt Acinetobacter sp. SFD, Beta-ketoacyl-ACP synthase III, ID:A0A178GG61_9GAMM, deposited Sep. 7, 2016. Retrieved from <https://www.uniprot.org/uniprot/A0A178GG61> on Apr. 2, 2021.
UniProt Acinetobacter tjembergiae DSM 14971, 3-oxoacyl-[acyl-carrier-protein] synthase, ID:V2UVU7_9GAMM, deposited Jan. 22, 2014, Retrieved from <https:77www.uniprot.org/uniprot/V2UVU7> on Apr. 2, 2021.
Valentin H E, et al., "Production of poly(3-hydroxybutyrate-co-4-hydroxybutyrate) in recombinant Escherichia coli grown on glucose", Journal of Biotechnology, Elsevier Science Publishers, Amsterdam, NL. Elsevier Science Publishers, Amsterdam, NL, vol. 58, No. 1, doi:10.1016/S0168-1656(97)00127-2, ISSN 0168-1656, XP004126101, Oct. 2, 1997, 33-38.
Van Kranenburg, et al., "Functional Analysis of Three Plasmids from Lactobacillus plantarum", doi: 10.1128/AEM.71.3.1223-1230. 2005 Appl. Environ. Microbiol. Mar. 2005 vol. 71 No. 3 1223-1230.
Vedantam, et al., "Characterization of mutations contributing to sulfathiazole resistance in Escherichia coli", Antimicrob Agents Chemother. 42(1), Jan. 1998, 88-93.
Vilcheze, et al., "Inactivation of the inhA-Encoded Fatty Acid Synthase II (FASII) Enoyl-Acyl Carrier Protein Reductase Induces Accumulation of the FASI End Products and Cell Lysis of Mycobacterium smegmatis", doi 10.1128/JB.182.14.4059-4067. 2000 J. Bacteriol., vol. 182 No. 14, Jul. 2000, 4059-4067.
Wankat, Phillip C., "Separation Process Engineering, Equilibrium Staged Separations", P.C. Wankat, Prentice Hall, Englewood Cliffs. NJ. USA., 1988.
Warnecke, et al., "A genomics approach to improve the analysis and design of strain selections", Metab Eng. 10 (3-4), May-Jul. 2008, 154-65.
Warnecke, et al., "Engineering of Organic Acid Tolerance Genes in E. coli for Biorefinery Applications", 2006 AIChE Annual meeting in San Francisco, California, Nov. 12-17, 2006, https://aiche.confex.comlaiche/2006/techprogram/P67122.HTM.
Warnecke, et al., "Identification of a 21 amino acid peptide conferring 3¬hydroxypropionic acid stress-tolerance to Escherichia coli", Biotechnol Bioeng.109(5). doi: 10.1002/bit.24398., May 2012, 1347-52.
Warnecke, et al., "Organic acid toxicity, tolerance, and production in Escherichia coli biorefining applications.", Microbial Cell Factories. 4(25), 2005, 1-8.

Warnecke, et al., "Rapid dissection of a complex phenotype through genomic-scale mapping of fitness altering genes", Metab Eng. 12(3), May 2010, 241-50.
Wasewar, et al., "Fermentation of Glucose to Lactic Acid Coupled with Reactive Extraction: A Review.", Ind. Eng. Chem. Res. 43, 2004, 5969-5982.
Waterson, et al., "Enoyl coenzyme A hydratase (crotonase). Catalytic properties of crotonase and its possible regulatory role in fatty acid oxidation", J Biol Chem. 247(16), Aug. 25, 1972, 5258-65.
Weilbacher, et al., "A novel sRNA component of the carbon storage regulatory system of Escherichia coil.", Molecular Microbiology, vol. 48, No. 3, [online] [Retrieved on Jul. 11, 2007]. [Retrieved from the internet: http://www.blackwell-synergy.com/links/doi/10.1046/1.1365-2958.2003.03459.x/full/], May 2003, 657-670.
Welch, et al., "Extensive mosaic structure revealed by the complete genome sequence of uropathogenic Escherichia coli", Proc Natl Acad Sci U S A. 99(26), Dec. 24, 2002, 17020-4.
Werpy, et al., "Top Value Added Chemicals From Biomass, vol. 1—Results Of Screening for Potential candidates From Sugars And Synthesis Gas", Pacific Northwest National Laboratory. U.S. Department of Energy, Aug. 2004.
Whisstock, et al., "Prediction of protein function from protein sequence and structure", Q Rev Biophys. 36(3), Aug. 2003, 307-40.
White, et al., "The overexpression, purification and complete amino acid sequence of chorismate synthase from Escherichia coli K12 and its comparison with the enzyme from Neurospora crassa", Biochem J. 251(2), Apr. 15, 1988, 313-22.
Winkler, Christoph K., et al., "Asymmetric bioreduction of activated alkenes to industrially relevant optically active compounds", J Biotechnol. 162(4), Dec. 31, 2012, 381-9.
Wishart, et al., "A single mutation converts a novel phosphotyrosine binding domain into a dual-specificity phosphatase", J Biol Chem. 270(45), Nov. 10, 1995, 26782-5.
Witkowski, et al., "Conversion of a beta-ketoacyl synthase to a malonyl decarboxylase by replacement of the active-site cysteine with glutamine.", Biochemistry. 38(36), Sep. 7, 1999, 11643-50.
"Advances in the Research of β-Ketoacyl-ACP Synthase III (FabH) Inhibitors", Liu xiaobo, et 2 al., Progress in Chemistry, 2009, vol. 21, No. 9, pp. 1930-1938, Sep. 30, 2009).
"Agriculture Project Fact Sheet", U.S. Department of Energy, Office of Industrial Technologies. Jul. 2001.
"Energetics Incorporated. 2003 Industrial Bioproducts: Today and Tomorrow. U.S. Department of Energy, Office of Energy Efficiency and Renewable Energy, Office of the Biomass Program, Washington, D C."
"GenBank Accession No. AAC74497.1; Apr. 24, 2007. 2 pgs."
"GenBank Accession No. NP 415816.1; available 1997".
"GenBank Accession No. NP 415933.1; available 1997".
"GenBank Accession No. NP 418045.4; available 1997".
"GenBank Accession No. X81461", AF473544, Sep. 7, 1994.
"GenBank Accession No. AAS20429.1", Jan. 19, 2004.
"NCBI Reference Sequence: NP_414657.1", Jan. 16, 1997.
"NCBI Reference Sequence: NP_415792.1", Jan. 16, 1997.
"NCBI Reference Sequence: NP_416366.1", Jan. 16, 1997.
"NCBI Reference Sequence: NP_418812.1", Jan. 16, 1997.
"NCBI Reference Sequence: WP_011957906.1", Jun. 6, 2007.
"NCBI Reference Sequence: WP_012121415.1", Sep. 4, 2007.
"NCBI Reference Sequence: WP_012616528.1", Dec. 29, 2008.
"NCBI Reference Sequence: YP_001636209.1", Dec. 21, 2007.
"NCBI Reference Sequence: ZP_01039179.1", Jan. 16, 2006.
"NCBI Reference Sequence: ZP_01626393.1", Dec. 15, 2006.
"NCBI Reference Sequence: ZP_04957196.1", Sep. 15, 2008.
"NCBI Reference Sequence: ZP_05125944.1", Sep. 15, 2008.
"Nexant, Inc. Chemsystems Perp Program, Acrylic Acid, 08/09-3", Jul. 2010.
Abdel-Hamid, Ahmed M., et al., "Coordinate Expression of the Acetyl Coenzyme A Carboxylase Genes, accB and accC, Is Necessary for Normal Regulation of Biotin Synthesis in Escherichia coli", J Bacteriol. 189(2), Jan. 2007, 369-76.
Alber, et al., "Malonyl-coenzyme A reductase in the modified 3-hydroxypropionate cycle for autotrophic carbon fixation in archaeal Metallosphaera and Sulfolobus spp.", spp. J Bacteriol Dec. 2006;188(24):8551-9.

(56) References Cited

OTHER PUBLICATIONS

Alberts, et al. Molecular Biology of the Cell. 3rd Ed. Garland Publishing, New York 1994; 42-45, 66-74.
Anagnostopoulos, C., et al., "Requirements for Transformation in Bacillus Subtilis", J Bacteriol. 81(5), May 1961, 741-6.
Anton, et al., "Sequencing and Overexpression of the *Escherichia coli* Aroe Gene Encoding Shikimate Dehydrogenase", Biochem J. Jan. 15, 1988;249(2):319-26.
Armstrong, S. M., et al., "Abiotic conversion of dihydrophloroglucinol to resorcinol", Canadian Journal of Microbiology. 39(9), 1993, 899-902.
Arthur, et al., "Contribution of VanY D,D-carboxypeptidase to glycopeptide resistance in Enterococcus faecalis by hydrolysis of peptidoglycan precursors", Antimicrob Agents Chemother. 38(9), Sep. 1994, 1899-1903.
Asano, et al., "A new enzymatic method of acrylamide production", Agricultural and Biological Chemistry. 46(5), 1982, 1183-1189.
Baek, Jong Hwan, et al., "Novel gene members in the Pho regulon of *Escherichia coli*", FEMS Microbiol Lett. 264 (1), Nov. 2006, 104-9.
Bailey, et al., "Inverse metabolic engineering: A strategy for directed genetic engineering of useful phenotypes", BBiotechnol Bioeng. 79(5), Sep. 5, 2002, 568-79.
Bailey, et al., "Toward a science of metabolic engineering", Science;252(5013):, Jun. 21, 1991, 1668-75.
Bailey, et al. Biochemical Engineering Fundamentals, 2nd Ed. McGraw Hill, New York, 1986, entire book for purposes indicated and Chapter 9, pp. 533-657.
Barbin, et al., "Induction of specific base-pair substitutions in *E. coli* trpA mutants by chloroethylene oxide, a carcinogenic vinyl chloride metabolite", Mutat Res. Nov.-Dec. 1985;152(2-3):147-56.
Bastian, et al., "Engineered ketol-acid reductoisomerase and alcohol dehydrogenase enable anaerobic 2-methylpropan-I-ol production at theoretical yield in *Escherichia coli*", Metab Eng. May 2011;13(3):345-52.
Beguin, et al., "The biological degradation of cellulose", FEMS Microbiol Rev. Jan. 1994;13(1):25-58.
Beisson, Frederic, et al., "*Arabidopsis* Genes Involved in Acyl Lipid Metabolism. A 2003 Census of the Candidates, a Study of the Distribution of Expressed Sequence Tags in Organs, and a Web-Based Database", Plant Physiol. 132(2), Jun. 2003, 681-97.
Bellion, Edward, et al., "Methylamine Utilization in Yeast and Bacteria: Studies Using in vivo NMR", Micro b. Growth C1 Compd. (Int. Symp.) 7th Editors: Murrell, J. Collin: Kelly, Don P. Publisher: Intercept, Andover, UK, 1993, 415-32.
Ben-Aroya, Shay, et al., "Toward a Comprehensive Temperature-Sensitive Mutant Repository of the Essential Genes of *Saccharomyces cerevisiae*". Molecular Cell. 30, 2008, 248-258.
Bergler, et al., "Sequences of the envM gene and of two mutated alleles in *Escherichia coli*", J Gen Microbiol. Oct. 1992;138(10):2093-100.
Bergler, et al., "The enoyl-[acyl-carrier-protein] reductase (Fabl) of *Escherichia coli*, which catalyzes a key regulatory step in fatty acid biosynthesis, accepts NADH and NADPH as cofactors and is inhibited by palmitoyl-CoA", Eur J Biochem. 242(3), Dec. 15, 1996, 689-94.
Bloch, et al., "Control mechanisms in the synthesis of saturated fatty acids", Annu Rev Biochem. 46, 1977, 263-98.
Bonner, et al., "A core catalytic domain of the TyrA protein family: arogenate dehydrogenase from Synechocystis", Biochem J. 382(Pt 1), Aug. 15, 2004, 279-91.
Bonner, William M., et al., "Purification and Properties of Fatty Acyl Thioesterase I from *Escherichia coli*", J Biol Chem. 247(10), Mar. 25, 1972, 3123-33.
Borgaro, et al. Substrate recognition by B-ketoacyl-ACP synthases. Biochemistry. Dec. 13, 2011; 50(49): 10678-86. doi: 10 1021/bi201199x. Epub Nov. 17, 2011.
Bowie, James U., et al., "Deciphering the Message in Protein Sequences: Tolerance to Amino Acid Substitutions", Science 247(4948), Mar. 16, 1990, 1306-10.
Branden, Carl, et al., "Introduction to Protein Structure", Garland Publishing Inc., New York, 1991, 247.
Bressler, et al., "Studies on the mechanism of fatty acid synthesis. XI. The product of the reaction and the role of sulfhydryl groups in the synthesis of fatty acids", J. Biol Chem. vol. 237, May 1962, 1441-1448.
Brock, et al., "Naturally occurring adenines within mRNA coding sequences affect ribosome binding and expression in *Escherichia coli*", J Bacteriol. Jan. 2007;189(2):501-10. Epub Nov. 3, 2006.
Wyckoff, et al., "Characterization and sequence analysis of a stable cryptic plasmid from Enterococcus faecium 226 and development of a stable cloning vector", Appl Environ Microbiol. Apr. 1996; 62(4): 1481-1486.
Xie, Dongming, et al., "Microbial Synthesis of Triacetic Acid Lactone", Biotechnol Bioeng. 93(4), Mar. 5, 2006, 727-36.
Xu, et al., "English Translation: Principles and Experiments of Biotechnology", China Minzu University Press. (English Translation), Jul. 2006, 229-231.
Xu, Xiaowei, "Fatty acid synthase inhibitors: research advances", Journal of international pharmaceutical research. vol. 36 (2). (English abstract), 2009, 105-108, 120.
Y. Yuan et al: "Pseudomonas aeruginosa Directly Shunts-Oxidation Degradation Intermediates into De Novo Fatty Acid Biosynthesis", Journal of Bacteriology, vol. 194, No. 19, Oct. 1, 2012, pp. 5185-5196, XP055749981, ISSN: 0021-9193, DOI: 10.1128/JB.00860-12.
Yee, et al., "On the role of helix 0 of the tryptophan synthetase alpha chain of *Escherichia coli*.", J Biol Chem. 271 (25), Jun. 21, 1996, 14754-63.
Yiming Ren, et al., "Molecular Iodine in Ionic Liquid: A Green Catalytic System for Esterification and Transesterification", Synthetic Communications. 40(11), 2010, 1670-1676.
Yoshida, et al., "Identification of PhoB binding sites of the yibD and ytfK promoter regions in *Escherichia coli*", J Microbiol. 49(2), Apr. 2011, 285-289.
Zha, Wenjuan, et al., "Improving cellular malonyl-CoA level in *Escherichia coli* via metabolic engineering", Metab Eng. 11(3), May 2009, 192-8.
Zhang, et al., "Inhibiting bacterial fatty acid synthesis", J. Biol. Chem. 281(26), Jun. 30, 2006, 17541-17544.
Zhang, Z et al., "Metabolic engineering of microbial pathways for advanced biofuels production", Current Opinion in Biotechnology, vol. 22, No. 6, ISSN 0958-1669, pp. 775-783.
ZHAO, "Binding of two flaviolin substrate molecules, oxidative coupling, and crystal structure of *Streptomyces coelicolor* A3(2) cytochrome P450 158A2.", J Biol Chem 280(12), Mar. 25, 2005,11599-607.
Zhou, et al., "Interdomain communication between the thiolation and thioesterase domains of EntF explored by combinatorial mutagenesis and selection", Chem Biol. 13(8), Aug. 2006, 869-79.
Brock, Thomas D, "Biotechnology: A Textbook of Industrial Microbiology", Second Edition Sinauer Associates, Inc. Sunderland, Mass., 1989.
Brosius, Jurgen, et al., "Spacing of the -10 and -35 Regions in the tac Promoter. Effect on its in vivo activity", J Biol Chem. 260(6), Mar. 25, 1985, 3539-41.
Broun, Pierre, et al., "Catalytic Plasticity of Fatty Acid Modification Enzymes Underlying Chemical Diversity of Plant Lipids", Science. 282(5392), Nov. 13, 1998, 1315-7.
Brown, et al., "Synthesis of labeled acrylamide and N-methylolacrylamide (NMA): 15N-acrylamide, 13C-NMA, 15N-NMA, and 13C,15N-NMA", Journal of labelled compounds & radiopharmaceuticals. 48(14): 1031-1039., Nov. 14, 2005.
Brutlag, Douglas L., et al., "Improved sensitivity of biological sequence database searches", Comput Appl Biosci 6(3), Mar. 25, 1990, 237-45.
Bunch, et al., "The IdhA gene encoding the fermentative lactate dehydrogenase of *Escherichia coli*", Microbiology Jan. 1997; 143 (Pt 1):187-95.
Canada, et al., "Directed evolution of toluene ortho-monooxygenase for enhanced 1¬naphthol synthesis and chlorinated ethene degradation", J Bacteriol. Jan. 2002;184(2):344-9.

(56) References Cited

OTHER PUBLICATIONS

Chang, et al., "Acetate metabolism in a pta mutant of *Escherichia coli* W3110: importance of maintaining acetyl coenzyme A flux for growth and survival", J Bacteriol. Nov. 1999;181(21):6656-63.

Chang, et al., "Probable polyketide synthase/thioesterase. NCBI Direct Submission, Accession No. GI50082961", Jun. 14, 2004.

Chao, et al., "Selective production of L-aspartic acid and L-phenylalanine by coupling reactions of aspartase and aminotransferase in *Escherichia coli*", Enzyme Microb Technol. 27(1-2), Jul. 1, 2000, 19-25.

Cheng, et al., "Mammalian wax biosynthesis: L Identification of two fatty acyl-Coenzyme A reductases with different substrate specificities and tissue distributions", Journal of Biological Chemistry, Sep. 3, 2004, vol. 279, No. 36, pp. 37789-37797.

Chica, Roberto A., et al., "Semi-rational approaches to engineering enzyme activity: combining the benefits of directed evolution and rational design", Curr Opin Biotechnol. 16(4), Aug. 2005, 378-84.

Cho, et al., "Simultaneous synthesis of enantiomerically pure (S)-amino acids and (R)¬amines using coupled transaminase reactions", Biotechnol Bioeng. Mar. 30, 2003;81(7):783-9.

Choi-Rhee, Eunjoo, et al., "The Biotin Carboxylase-Biotin Carboxyl Carrier Protein Complex of *Escherichia coli* Acetyl-CoA Carboxylase", J Biol Chem. 278(33), Aug. 15, 2003, 30806-12.

Chotani, et al., "The commercial production of chemicals using pathway engineering", Biochim Biophys Acta. Dec. 29, 2000;1543(2):434-455.

Cleusix, et al., "Inhibitory activity spectrum of reuterin produced by Lactobacillus reuteri against intestinal bacteria", BMC Microbiology, 7: 101, Nov. 12, 2007, 9 Pages.

Coleman, Rosalind A., et al., "Enzymes of triacylglycerol synthesis and their regulation", Prog Lipid Res. 43(2), Mar. 2004, 134-76.

Cowan, Peter J., et al., "Characterization of the Major Promoter for the Plasmid-Encoded Sucrose Genes scrY, scrA, and scrB", J Bacteriol. 173(23), Dec. 1991, 7464-70.

Crameri, et al., "DNA shuffling of a family of genes from diverse species accelerates directed evolution", Nature. Jan. 15, 1998;391(6664):288-91.

Cronan, et al., "Genetic and biochemical analyses of pantothenate biosynthesis in *Escherichia coli* and *Salmonella typhimurium*.", J Bacteriol. Mar. 1982; 149(3):916-22.

Cronan, J.E, "Beta-Alanine Synthesis in *Escherichia coli*", J Bacteriol. Mar. 1980;141(3):1291-7.

Cronk, et al. "Cloning, crystallization and preliminary characterization of a beta-carbonic anhydrase from *Escherichia coli*", Acta Crystallogr D Biol Crystallogr. Sep. 2000;56(Pt 9): 1176-9.

Daley, Daniel O., et al., "Global Topology Analysis of the *Escherichia coli* Inner Membrane Proteome", Science, 308 (5726), May 27, 2005, 1321-3.

Daniel, Jaiyanth, et al., "Induction of a Novel Class of Diacylglycerol Acyltransferases and Triacylglycerol Accumulation in *Mycobacterium tuberculosis* as It Goes into a Dormancy-Like State in Culture", J Bacteriol. 186(15), Mar. 2004, 5017-30.

Daruwala, et al., "Menaquinone (vitamin K2) biosynthesis: overexpression, purification, and characterization of a new isochorismate synthase from *Escherichia coli*", J. Bacteriol. 179(10), May 1997, 3133-8.

Datsenko, Kirill A., et al., "One-step inactivation of chromosomal genes in *Escherichia coli* K-12 using PCR products". Proc Natl Acad Sci USA. 97(12), Jun. 6, 2000, 6640-5.

Datta, Simanti, et al., "A set of recombineering plasmids for gram-negative bacteria", Gene. 379, Sep. 1, 2006, 109-15.

Davis, Mark S., et al., "Overproduction of Acetyl-CoA Carboxylase Activity Increases the Rate of Fatty Acid Biosynthesis in *Escherichia coli**", The Journal of Biological Chemistry (2000), vol. 275, p. 28593-28598, 2000, 28593-28598.

De Boer, Herman A., et al., "The tac promoter: A functional hybrid derived from the trp and lac promoters", Proc Natl Acad Sci USA 80(1), Jan. 1983, 21-5.

De Mendoza, et al., "Thermal regulation of membrane lipid fluidity in bacteria", Trends Biochem. Sci. 1983; 8:49-52.

DELL'AQUILA, et al., "Acid-base balance in peritoneal dialysis", J Nephrol. Mar.-Apr. 2006;19 Suppl 9:S104-7.

Dellomonaco, et al., "Engineered reversal of the β-oxidation cycle for the synthesis of fuels and chemicals", Nature Aug. 18, 2011, 476 (7360): 355-9.

Dellomonaco, C et al., "Engineered reversal of the [beta]-oxidation cycle for the synthesis of fuels and chemicals—supplementary information", NATURE, vol. 476, No. 7360, ISSN 0028-0836, pp. 355-359.

Dellomonaco, C et al., "Engineered reversal of the [beta]-oxidation cycle for the synthesis of fuels and chemicals", NATURE, vol. 476, No. 7360, ISSN 0028-0836, pp. 355-359.

Demmer, Ulrike, et al., "Structural Basis for a Bispecific NADP and CoA Binding Site in an Archaeal Malonyl-Coenzyme A Reductase", J Biol Chem. 288(9), Mar. 1, 1990, 6363-70.

Den, et al., "Enzymatic Conversion of 13-Hydroxypropionate to Malonic Semialdehyde*", J Biol Chem Jul. 1959;234 (7): 1666-1671.

Denic, et al., "A Molecular Caliper Mechanism for Determining Very Long-Chain Fatty Acid Length", vol. 130, Issue 4, Aug. 24, 2007, Aug. 24, 2007, 663-377.

Deshpande, Mukund V., "Ethanol Production from Cellulose by Coupled Saccharification/Fermentation using *Saccharomyces cerevisiae* and Cellulase Complex from Sclerotium rolfsii UV-8 Mutant", Appl Biochem Biotechnol. 36 (3), 1992, 227-34.

Devos, Damien, et al., "Practical Limits of Function Prediction", Proteins. 41(1), Oct. 1, 2000, 98-107.

Dewick, P., "Chapter 4. The Shikimate Pathway: Aromatic Amino Acids and Phenylpropanoids", Medicinal Natural Products: A Biosynthetic Approach, Second Edition (2002): 121-166.

Diaz, et al., "Characterization of the hca cluster encoding the dioxygenolytic pathway for initial catabolism of 3-phenylpropionic acid in *Escherichia coli* K-12", J Bacteriol. Jun. 1998;180(11):2915-23.

Dittrich, Franziska, et al., "Fatty acid elongation in yeast. Biochemical characteristics of the enzyme system and isolation of elongation-defective mutants", Eur J Biochem. 252(3), Mar. 15, 1998, 477-85.

Dohr, Olaf, et al., "Engineering of a functional human NADH-dependent cytochrome P450 system", Proc Natl Acad Sci USA. 98(1), Jan. 2, 2001, 81-6.

Doroshenko, Vera G., et al., "Pho regulon promoter-mediated transcription of the key pathway gene aroGFbr improves the performance of an L-phenylalanine-producing *Escherichia coli* strain", Applied Microbiology and Biotechnology 88, 2010, 1287-1295.

Drake, et al., "Structure of the EntB Multidomain Nonribosomal Peptide Synthetase and Functional Analysis of Its Interaction with the EntE Adenylation Domain", Chem Biol. Apr. 2006;13(4):409-19.

Duncan, et al., "Lactate-utilizing bacteria, isolated from human feces, that produce butyrate as a major fermentation product", Appl Environ Microbiol. Oct. 2004;70(10):5810-7.

Duncan, et al., "The overexpression and complete amino acid sequence of *Escherichia coli* 3-dehydroquinase", Biochem J. Sep. 1, 1986 ;238(2):475-83.

Elvin, Christopher M., et al., "Modified bacteriophage lambda promoter vectors for overproduction of proteins in *Escherichia coli*", Gene. 87(1), Mar. 1, 1990, 123-6.

Eppink, Michel H. M., et al., "Switch of Coenzyme Specificity of p-Hydroxybenzoate Hydroxylase", J Mol Biol. 292 (1), Sep. 10, 1999, 87-96.

Epstein, et al., "Oil: A Life Cycle Analysis of its Health and Environmental Impacts", The Center for Health and the Global Environment, Harvard Medical School. Mar. 2002 www.med.harvard.edu/chge/oil.html.

Erb, et al., "Carboxylation mechanism and stereochemistry of crotonyl-CoA carboxylase/reductase, a carboxylating enoyl-thioester reductase", Proc Natl Acad Sci U S A. Jun. 2, 2009; 106(22): 8871-8876. Published online May 20, 2009. doi: 10.1073/pnas.0903939106, 8871-8876.

Extended European Search Report dated Mar. 7, 2016 in Patent Application 15182914.0.

(56) References Cited

OTHER PUBLICATIONS

Fan, L et al., "Synthesis of medium chain length fatty acid ethyl esters in engineered *Escherichia coli* using endogenously produced medium chain fatty acids", Enzyme and Microbial Technology, vol. 53, No. 2, ISSN 0141-0229, pp. 128-133.

Farmer, et al., "Improving lycopene production in *Escherichia coli* by engineering metabolic control", Nat Biotechnol. May 2000;18(5):533-7.

Felce, Jeremy, et al., "Carbonic Anhydrases Fused to Anion Transporters of the SulP Family Evidence for a Novel Type of Bicarbonate Transporter", J Mol Microbiol Biotechnol. 8(3), 2004, 169-76.

Fernando, et al., "Biorefineries: current status, challenges and future direction", Energ Fuel. May 2006 20:1727-1737.

Figge, "Methionine biosynthesis is *Escherichia coli* and Corynebacterium glutamicum", Microbiol Monogro. 2007; 5:163-193.

Fleming, et al., "Extracellular enzyme synthesis in a sporulation-deficient strain of Bacillus licheniformis", Appl Environ Microbiol, Nov. 1995, 61 (11):3775-3780.

Fodor, et al., "Light-Directed, Spatially Addressable Parallel Chemical Synthesis", Science. Feb. 15, 1991, 251 (4995):767-73.

Fowler, Zachary L., et al., "Increased Malonyl Coenzyme A Biosynthesis by Tuning the *Escherichia coli* Metabolic Network and Its Application to Flavanone Production", Appl Environ Microbiol. 75(18), Sep. 2009, 5831-9.

Fujimoto, et al., "pAM401-Based Shuttle Vectors That Enable Overexpression of Promoterless Genes and One-Step Purification of Tag Fusion Proteins Directly from Enterococcus faecalis", doi: 10.1128/AEM.67.3.1262-1267.2001 Appl. Environ. Microbiol. Mar. 2001 vol. 67 No. 3 1262-1267.

Funa, et al., "A novel quinone-forming monooxygenase family involved in modification of aromatic polyketides", J Biol Chem. Apr. 15, 2005;280(15):14514-23. Epub Feb. 8, 2005.

Gietz, R. Daniel, et al., "Transformation of Yeast by Lithium Acetate/Single-Stranded Carrier DNA/Polyethylene Glycol Method", Methods Enzymol. 350, 2002, 87-96.

Giladi, et al., "FolM, a new chromosomally encoded dihydrofolate reductase in *Escherichia coli*", J Bacteriol. 185 (23), Dec. 2003, 7015-8.

Gilbert, Walter, et al., "Useful Proteins from Recombinant Bacteria", Sci Am. 242(4), Apr. 1980, 74-94.

Gill, et al., "Genome-wide screening for trait conferring genes using DNA microarrays", Proc Natl Acad Sci U S A. May 14, 2002;99(10):7033-8. Epub May 7, 2002.

Ginkel, et al., "Identification and cloning of the *Mycobacterium avium* folA gene, required for dihydrofolate reductase activity", FEMS Microbiology Letters vol. 156, Issue 1, Nov. 1, 1997, 69-78.

Gokarn, et al., "Metabolic analysis of *Escherichia coli* in the presence and absence of the carboxylating enzymes phosphoenolpyruvate carboxylase and pyruvate carboxylase", Appl Environ Microbiol. May 2000;66(5): 1844-50.

Goodwin, et al., "Purification and characterization of methylmalonate-semialdehyde dehydrogenase from rat liver. Identity to malonate-semialdehyde dehydrogenase", J Biol Chem. Sep. 5, 1989;264(25):14965-71.

Gray, et al., "Monofunctional chorismate mutase from Bacillus subtilis: purification of the protein, molecular cloning of the gene, and overexpression of the gene product in *Escherichia coli*", Biochemistry. Jan. 16, 1990;29(2):376-83.

Gronenborn, Bruno, "Overproduction of Phage Lambda Repressor under Control of the lac Promotor of *Escherichia coli*", Mol Gen Genet. 148(3), Nov. 17, 1976, 243-50.

Gu, et al., "Polyketide Decarboxylative Chain Termination Preceded by O-Sulfonation in Curacin A Biosynthesis", J Am Chem Soc. Nov. 11, 2009; 131(44): 16033-16035. doi: 10.1021/ja9071578.

Gulmezian, et al., "Genetic Evidence for an Interaction of the UbiG O-Methyltransferase with UbiX in *Escherichia coli* Coenzyme Q Biosynthesis", J Bacteriol. Sep. 2006;188(17):6435-9.

Guzman, L. M., et al., "Tight regulation, modulation, and high-level expression by vectors containing the *Arabinose* PBAD promoter", J Bacteriol. 177(14), Jul. 1995, 4121-30.

Haldimann, Andreas, et al., "Use of New Methods for Construction of Tightly Regulated *Arabinose* and Rhamnose Promoter Fusions in Studies of the *Escherichia coli* Phosphate Regulon", J Bacteriol. 180(5), Mar. 1998, 1277-86.

Hall, Neil, et al., "Structure-function analysis of NADPH: nitrate reductase from Aspergillus nidulans: analysis of altered pyridine nucleotide specificity in vivo", Microbiology. 146 (Pt.6), Jun. 2000, 1399-406.

Hatzimanikatis, et al., "Exploring the diversity of complex metabolic networks", Bioinformatics. Apr. 15, 2005;21 (8):1603-9. Epub Dec. 21, 2004.

He, et al., "A T42M Substitution in Bacterial 5-Enolpyruvylshikimate-3-phosphate Synthase (EPSPS) Generates Enzymes with Increased Resistance to Glyphosate", Biosci Biotechnol Biochem. vol. 67, 2003-Issue 6, 1405-1409.

Heath, et al. Enoyl-acyl carrier protein reductase (fabI) plays a determinant role in completing cycles of fatty acid elongation in *Escherichia coli* J. Biol Chem Nov. 3, 1995;270(44):26538-42.

Helge, Jans, et al., "Fatty acid synthesis in *Escherichia coli* and its applications towards the production of fatty acid based biofuels", Biotechnology for Biofuels, vol. 7, No. 1, XP-021173667, Jan. 9, 2014.

Henry, et al., "Discovery of novel routes for the biosynthesis of industrial chemicals: 3-Hydroxypropanoate. Slides", AICHE Annual Meeting. Nov. 8, 2007. Salt Lake City, UT.

Herter, "Autotrophic CO2 Fixation by Chloroflexus aurantiacus: Study of Glyoxylate Formation and Assimilation via the 3-Hydroxypropionate Cycle", J Bacteriol Jul. 2001;183(14):4305-4316.

Hondorp, et al., "Oxidation of cysteine 645 of cobalamin-independent methionine synthase causes a methionine limitation in *Escherichia coli*", J Bacteriol. May 2009;191(10):3407-10. Epub Mar. 13, 2009.

Hugler, et al., "Malonyl-Coenzyme A Reductase from Chloroflexus aurantiacus, a Key Enzyme of the 3-Hydroxypropionate Cycle for Autotrophic CO2 Fixation", J Bacteriol May 2002;184(9):2404-2410.

Kuo Miyahisa, et al., "Efficient production of (2S)-flavanones by *Escherichia coli* containing an artificial biosynthetic gene cluster", Applied Microbiology and Biotechnology, Springer, Berlin, DE, (Sep. 1, 2005), vol. 68, No. 4, doi:10.1007/S00253-005-1916-3, ISSN 1432-0614, pp. 498-504, XP019331939.

International search report and written opinion dated Feb. 4, 2015 for PCT/US2014/047320.

Ivanova, et al., "Genome sequence of Bacillus cereus and comparative analysis with Bacillus anthracis", Nature. May 1, 2003 ;423(6935):87-91.

James, Ethan S., et al., "Expression of two *Escherichia coli* acetyl-CoA carboxylase subunits is autoregulated", J. Biol Chem 279(4), Jan. 23, 2004, 2520-7.

Jan Podkowinski, et al., "OPINIONS Acetyl-coenzyme A carboxylase—an attractive enzyme for biotechnology", Biotechnologia, PL, (Jan. 1, 2011), vol. 4, doi:10.5114/bta.2011.46549, ISSN 0860-7796, pp. 321-335, XP055303418.

Jenkins, et al., "Genetic and molecular characterization of the genes involved in short-chain fatty acid degradation in *Escherichia coli*: the ato system", J Bacteriol. Jan. 1987; 169(1): 42-52.

Jiang, et al., "Biosynthetic pathways for 3-hydroxypropionic acid production", Appl Microbiol Biotechnol. Apr. 2009;82 (6):995-1003.

Jing, et al., "Phylogenetic and experimental characterization of an acyl-ACP thioesterase family reveals significant diversity in enzymatic specificity and activity", BMC Biochemistry201112:44. https://doi.org/10.1186/1471-2091-12-44.

Joike, et al., "Amino acid substitutions affecting catalytic activity and subunit interactions of aminodeoxychorismate synthase in *E. coli*". Abstracts of the General Meeting of the American Society for Microbiology. 2002; 102:275-276, and 102nd General Meeting of the American Society for Microbiology; Salt Lake, UT, USA; May 19-23, 2002.

(56) References Cited

OTHER PUBLICATIONS

Juliano Alves, et al., "Cloning, expression, and enzymatic activity ofandacetyl-coenzyme A carboxylases", Analytical Biochemistry, Academic Press Inc, New York, vol. 417, No. 1, doi:10.1016/J. AB.201 1.05.041, ISSN 0003-2697, (May 25, 2011), pp. 103-111, (Jun. 1, 2011), XP028245778.

Jung, et al., "Jung et al., Wax-deficient antherl is involved in cuticle and wax production in rice anther walls and is required for pollen development", and is required for pollen development, Plant Cell, Nov. 2006, vol. 18, No. 11, pp. 3015-3032.

Kapol, et al., "Purification and characterization of 2-oxoglutarate decarboxylase of Leuconostoc oenos", Journal of General Microbiology 136 (1990), 1497-1499.

Katavic, et al. Alternation of seed fatty acid composition by an ethyl methanesulfonate-induced mutation in Arabidopsis thaliana affecting diacylglycerol acyltransferase activity. Plant Physiol. May 1995; 108(1):399-409.

Katsuyama, Yohei, et al., "Production of curcuminoids by Escherichia coli carrying an artificial biosynthesis pathway". Microbiology. 154(Pt 9), Sep. 2008, 2620-8.

Kern, et al., "Engineering primary metabolic pathways of industrial micro-organisms", J Biotechnol. Mar. 30, 2007;129 (1) 6-29 Epub Dec. 2, 2006.

Meades, Glen, et al., "A tale of two functions: enzymatic activity and translational repression by carboxyltransferase". Nucleic Acids Res. 38(4), Mar. 2010, 1217-27.

Mehta, et al., "Aminotransferases: demonstration of homology and division into evolutionary subgroups", Eur J Biochem. 214(2), Jun. 1, 1993, 549-61.

Meng, et al., "Nucleotide sequence of the Escherichia coli cad operon: a system for neutralization of low extracellular pH", J. Bacteriol. vol. 174 No. 8, Apr. 1992, 2659-2669.

Meng, Xin, et al., "Increasing fatty acid production in E. coli by simulating the lipid accumulation of oleaginous microorganisms", Journal of Industrial Microbiology and Biotechnology 38(8), 2011, 919-925.

Milton, et al., "In vitro mutagenesis and overexpression of the Escherichia coli trpA gene and the partial characterization of the resultant tryptophan synthase mutant alpha-subunits", Biol Chem. 261(35), Dec. 15, 1986, 16604-15.

Mohan Raj, et al., "Effect of process parameters on 3-hydroxypropionic acid production from glycerol using a recombinant Escherichia coli", Appl Microbiol Biotechnol. 84(4), Sep. 2009, 649-57.

Moreau, et al., "Diversion of the metabolic flux from pyruvate dehydrogenase to pyruvate oxidase decreases oxidative stress during glucose metabolism in nongrowing Escherichia coli cells incubated under aerobic, phosphate starvation conditions", J Bacteriol. 186(21), Nov. 2004, 7364-8.

Muday, et al., "The tyrosine repressor negatively regulates aroH expression in Escherichia coli", 173(12), Jun. 1991, 3930-2.

Nackley, et al., "Human Catechol-O-Methyltransferase Haplotypes Modulate Protein Expression by Altering mRNA Secondary Structure", Science. 314(5807)., Dec. 22, 2006, 1930-3.

Nelson, David L., et al., "Principles of Biochemistry 3rd Ed.", Worth Publishers New York, 2000, 527-658.

NICHOLS, "Cloning and sequencing of Escherichia coli ubiC and purification of chorismate lyase", J Bacteriol. 174 (16), Aug. 1992, 5309-16.

NICHOLSON. Lipid Metabolism. Graphic design. 2002.

NUGENT. Development of Improved Chemicals and Plastics from Oilseeds. Final technical report. The Dow Chemical Company. DE-FC36-01ID14213. Jul. 31, 2006.

Ohmiya, et al., "Structure of Cellulases and Their Applications", Biotechnol. Genet. Eng. Rev., vol. 14, 1997, 365-414.

Ohnishi, et al., "A novel methodology employing Corynebacterium glutamicum genome information to generate a new L-lysine-producing mutant", Appl Microbiol Biotechnol. 58(2), Feb. 2002, 217-23.

Oliveira, et al., "Cloning and Overexpression in Soluble Form of Functional Shikimate Kinase and 5-Enolpyruvylshikimate 3-Phosphate Synthase Enzymes from Mycobacterium tuberculosis", Protein Expr Purif. 22(3)., Aug. 2001, 430-5.

Orjuela, et al., "Presentation: Recovery of succinic acid from fermentative broth through esterification with ethanol", Department of Chemical Engineering and Materials Science. Michigan State University. East Lansing, Michigan 48824 Jun. 29, 2010.

O'Sullivan, et al., "High- and low-copy-Number Lactococcus shuttle cloning vectors with features for clone screening", Gene. vol. 137, Issue 2, Dec. 31, 1993, pp. 227-231.

Ozcelik, et al., "Metabolic engineering of aromatic group amino acid pathway in Bacillus subtilis for L-phenylalanine production", Chemical Engineering Science 59(22-23):, 2004, 5019-5026.

Papanikolaou, Seraphim, et al., "Lipid production by Yarrowia lipolytica growing on industrial glycerol in a single-stage continuous culture", Bioresour Technol. 82(1), Mar. 2002, 43-9.

Parikh, et al., "Directed evolution of RuBisCO hypermorphs through genetic selection in engineered E.coli", Protein Eng Des Sel. 19(3), Mar. 2006, 113-9.

Park, et al., "Production of alternatives to fuel oil from organic waste by the alkane-producing", Vibrio furnissii MI, Journal of Applied Microbiology, 2005, vol. 98, No. 2, pp. 324-331.

Partial European Search Report dated Jan. 8, 2016 in Patent Application No. 15182914.0.

Patnaik, et al., "Genome shuffling of Lactobacillus for improved acid tolerance", Nat Biotechnol. 20(7), Jul. 2002, 707-12.

Pohl, et al., "A new perspective on thiamine catalysis", Curr Opin Biotechnol. 15(4), Aug. 2004, 335-42.

Ponce, et al., "Ioning of the Two Pyruvate Kinase Isoenzyme StructuralGenes from Escherichia coli: the Relative Roles of These Enzymes in Pyruvate Biosynthesis", J Bacteriol. 177(19), Oct. 1995, 5719-22.

Popp, J., "Sequence and overexpression of the menD gene from Escherichia coli", J Bacteriol. 171(8), Aug. 1989, 4349-54.

Prather, Kristala L, et al., "De novo biosynthetic pathways: rational design of microbial chemical factories", Curr Opin Biotechnol 19(5), Oct. 19, 2008, 468-74.

Price-Carter, et al., "Polyphosphate kinase protects Salmonella enterica from weak organic acid stress", Journal of Bacteriology. 187, 2005, 3088-3099.

Ramalinga, et al., "A mild and efficient method for esterification and transesterification catalyzed by iodine", Tetrahedron Letters 43(5), 2002, 879-882.

Ramey, et al., "Poster—Translation of genomics data into useful metabolic engineering strategies: construction of a 3-hydroxypropionic acid tolerant E. coli", 2010.

Ramilo, et al., "Overexpression, purification, and characterization of tyrosine-sensitive 3-deoxy-D-arabino-heptulosonic acid 7-phosphate synthase from Escherichia coli", Protein Expr Purif. 9(2), Mar. 1997, 253-61.

Rathnasingh, et al., "Development and evaluation of efficient recombinant Escherichia coli strains for the production of 3-hydroxypropionic acid from glycerol", Biotechnol Bioeng. 104(4). doi: 10.1002/bit.22429., Nov. 1, 2009, 729-39.

Rathnasingh, Chelladurai, et al., "Production of 3-hydroxypropionic acid via malonyl-COA pathway using recombinant Escherichia coli strains", J Biotechnol. 157(4), Feb. 20, 2012, 633-40.

Ray, et al., "Mutational analysis of the catalytic and feedback sites of the tryptophan-sensitive 3-deoxy-D-arabino-heptulosonate-7-phosphate synthase of Escherichia coli", J Bacteriol. 170(12), Dec. 1988, 5500-6.

Renault, et al., "Plasmid vectors for Gram-positive bacteria switching from high to low copy number", Gene. vol. 183, Issues 1-2, 1996, pp. 175-182.

Rodriguez, et al., "Structure-cytoprotective activity relationship of simple molecules containing an alpha,beta-unsaturated carbonyl system", J Med Chem. 40(12), Jun. 6, 1997,1827-34.

Roe, et al., "Inhibition of Escherichia coli growth by acetic acid: a problem with methionine biosynthesis and homocysteine toxicity", Microbiology. 148(Pt 7), Jul. 2002, 2215-2222.

Sadowski, M. I., et al., "The sequence-structure relationship and protein function prediction", Current Opinion in Structural Biology 19, 2009, 357-362.

(56) References Cited

OTHER PUBLICATIONS

Saerens, S. M. G., et al., "Parameters Affecting Ethyl Ester Production by *Saccharomyces cerevisiae* during Fermentation", Appl Environ Microbiol. 74(2), Jan. 2008, 454-61.
Saier, et al., "The catabolite repressor/activator (Cra) protein of enteric bacteria", J Bacteriol. 178(12), Jun. 1996, 3411-7.
Salis, Howard M., et al., "Automated Design of Synthetic Ribosome Binding Sites to Precisely Control Protein Expression", Nat Biotechnol 27(10), Oct. 2009, 946-50.
Sambrook and Russell, "Molecular Cloning: A Laboratory Manual," Third Edition 2001 (vols. 1-3), Cold Spring Harbor Laboratory Press, Cold Spring Harbor, N.Y.
Sauna, et al., "Silent polymorphisms speak: how they affect pharmacogenomics and the treatment of cancer", Cancer Research 67(20), Oct. 15, 2007, 9609-12.
Schmid, Katherine M., et al., "Lipid Metabolism in Plants", Biochemistry of Lipids, Lipoproteins and memebranes. Ch 4, 2002, 93-126.
Schmidt-Dannert, et al., "Molecular breeding of carotenoid biosynthetic pathways", Nat Biotechnol. 18(7), Jul. 2000, 750-3.
Seffernick, Jennifer L., et al., "Melamine Deaminase and Atrazine Chlorohydrolase: 98 Percent Identical but Functionally Different", J Bacteriol. 183(8), Apr. 2001, 2405-10.
Sen, S., et al., "Developments in Directed Evolution for Improving Enzyme Functions", Appl Biochem Biotechnol. 143 (3), Dec. 2007, 212-23.
Service, "Sugary Recipe Boosts Grow-Your-Own Plastics", Science. 312(5782), Jun. 30, 2006, 1861.
Shelden, Megan C., et al., "Membrane topology of the cyanobacterial bicarbonate transporter, BicA, a member of the SulP (SLC26A) family", Molecular Membrane Biology vol. 27(1), 2010, 12-22.

Abdel-Hamid et al., "Pyruvate oxidase contributes to the aerobic growth efficiency of *Escherichia coli*," Microbiology, 2001, 147(Pt 6):1483-1498.
Antonenkov et al., "Substrate Specificities of 3-Oxoacyl-CoA Thiolase A and Sterol Carrier Protein 2/3-Oxoacyl-CoA Thiolase Purified from Normal Rat Liver Peroxisomes," J. Biol. Chem., 1997, 272(41):P26023-26031.
Chang et al., "Genetic and biochemical analyses of *Escherichia coli* strains having a mutation in the structural gene (poxB) for pyruvate oxidase," J Bacteriol, 1983, 154(2):756-62.
Choi et al., "beta-ketoacyl-acyl carrier protein synthase III (FabH) is a determining factor in branched-chain fatty acid biosynthesis," J Bacteriol. Jan. 2000;182(2):365-70.
Heath et al., "Lipid biosynthesis as a target for antibacterial agents," Prog. Lipid Res, 2001 40(6):467-497.
Khandekar et al., "Identification, Substrate Specificity, and Inhibition of the *Streptococcus pneumoniae* β-Ketoacyl-Acyl Carrier Protein Synthase III (FabH)," J. Biol. Chem., 276:32, P30024-30030 2001.
Mat-Jan et al., "Mutants of *Escherichia coli* deficient in the fermentative lactate dehydrogenase," J Bacteriol. 1989, 171 (1):342-8.
McCue et al., "Phylogenetic footprinting of transcription factor binding sites in proteobacterial genomes," Nucleic Acids Res., 29(3):774-82, 2001.
Qui et al., "Crystal structure and substrate specificity of the beta-ketoacyl-acyl carrier protein synthase III (FabH) from *Staphylococcus aureus*," Protein Science (2005), 14:2087-2094.
Zhang et al., "The FabR (YijC) Transcription Factor Regulates Unsaturated Fatty Acid Biosynthesis in *Escherichia coli*," J. Biol. Chem. 277 (18):15558-65, 2002.

\* cited by examiner (Note that C18, C18.1 and C18.2 are stearic acid, oleic acid, and linoleic acid, respectively)

Thioesterase (specific activity U/mg on best CoA substrate)

MICROORGANISMS AND METHODS FOR THE PRODUCTION OF FATTY ACIDS AND FATTY ACID DERIVED PRODUCTS

CROSS-REFERENCE TO RELATED APPLICATIONS

This application is a Continuation of U.S. patent application Ser. No. 14/904,862, filed Jan. 13, 2016, which is a national phase application of International Application No. PCT/US2014/047320, filed Jul. 18, 2014, which claims the benefit of U.S. Provisional Patent Application No. 61/856,652 filed Jul. 19, 2013, all of which are hereby incorporated by reference herein in their entirety.

STATEMENT REGARDING FEDERALLY SPONSORED RESEARCH

This invention was made with Government support under DE-AR0000088 awarded by the United States Department of Energy. The Government has certain rights in this invention.

SEQUENCE LISTING

The instant application contains a Sequence Listing which has been submitted in ASCII format via EFS-Web and is hereby incorporated by reference in its entirety. Said ASCII copy, created on Jan. 22, 2016 is named 24433-780-981-SL.txt and is 905 Kilobytes in size.

BACKGROUND

Fatty acid and fatty acid derivatives (such as fatty acid methyl esters (FAME), fatty alcohols, fatty amines, etc.) are important precursors to manufacturing many consumer products, industrial chemicals and fuels. For example, fatty acids and fatty acid derivatives are used to make detergents, cleaners, plastics, paper, paints, lubricants, waxes, coatings and surfactants. They can also be used as flavor and fragrance agents. Currently, fatty acids and fatty acid derivatives are produced from oleochemical (plant and animal fats) or petrochemical sources. In general, the fatty acids derived from oleochemical sources have aliphatic chains with an even number of carbons, whereas fatty acids derived from petrochemical sources have aliphatic chains with an odd number of carbons.

Both oleochemical and petrochemical fatty acids have significant shortcomings. Most notably, the feedstocks used to produce such fatty acids generally include a mixture of fatty acids of varying carbon chain lengths and may include a wide range of chain lengths, as well as saturated and unsaturated fatty acids. FIG. 1 is a chart that illustrates the fatty acid carbon composition of various common oleochemical feedstocks. Many of the commercial applications for fatty acids and fatty acid derivatives, however, require a fatty acid precursor having greater specificity with respect to its aliphatic chain lengths. For example, C6-C10 fatty acids are used in the production of jet lubricants, C12-C14 fatty acids are used to make surfactants and detergents, and C16-C18 fatty acids are used for metal soap production. As a result, current fatty acid production methods require costly feedstock processing procedures, such as fractionation and distillation, in order to isolate the fatty acid components required for a given application. There are technical limits to the effectiveness of such processing procedures and their ability to isolate relatively high concentrations of fatty acids of isolated chain lengths.

Another short coming of oleochemical and petrochemical fatty acids is the wide fluctuation in the cost of the feedstocks. Oleochemical feedstock prices are extremely volatile and can significantly fluctuate from year to year and fluctuate among the various geographic regions. Since overall production costs are very sensitive to feedstock price, such volatility can significantly impact margins. Regarding petrochemical fatty acids, there is increasing acceptance that petroleum hydrocarbon supplies are decreasing, and as a result their costs are expected to continue to increase.

Finally, there is increasing concern regarding sustainability within the chemical industry, and there is a growing demand for chemicals produced from renewable resources. In fact, many chemical companies and their customers have implemented sustainability initiatives with a goal of replacing current chemicals such as petro-based chemicals with chemicals made from renewable sources. Such companies are seeking renewable chemicals that have minimal impact on product performance or characteristics, as well as minimal impact on downstream products and customers. There are even sustainability concerns within the oleochemical industry. Although many of the oleochemical fatty acids are derived from renewable resources, current industry practices do not manage the harvesting of these resources in a sustainable way. For example, there has been significant concern regarding deforestation in the production of palm oil, a primary source for oleochemical fatty acids.

In view of these shortcomings regarding petro-based and oleo-based fatty acids and fatty acid derivatives, interest has increased for developing and improving industrial microbial systems for production of chemicals and fuels using sustainable plant-based feedstocks. Such industrial microbial systems could completely or partially replace the use of petroleum hydrocarbons or oleochemicals for production of certain chemicals and products.

Numerous chemicals are produced through such microbial systems, ranging from antibiotic and anti-malarial pharmaceutical products to fine chemicals to fuels such as ethanol. However, there is still a commercial need for modified microorganisms that are adapted to produce fatty acids and fatty acid derived products, and in particular, fatty acid and fatty acid derived products that have a high concentration of a specific fatty acid chain length.

SUMMARY OF THE INVENTION

In one aspect the disclosure provides for a genetically modified organism comprising a heterologous nucleic acid sequence encoding a 3-ketoacyl-CoA synthase, a ketoacyl-CoA reductase, a hydroxyacyl-CoA dehydratase, or an enoyl-CoA reductase; and wherein said microorganism is capable of producing a fatty acid or fatty acid-derived product having a carbon chain length of C4 or greater. In some embodiments, the 3-ketoacyl-CoA synthase comprises NphT7. In some embodiments, the 3-ketoacyl-CoA synthase comprises an amino acid sequence of at least 70% homology to any one of SEQ ID NOs. 1-120. In some embodiments, the ketoacyl-CoA reductase is selected from the group consisting of a 3-ketobutyryl-CoA reductase, a 3-hydroxybutyryl-CoA dehydrogenase, a 3-ketovaleryl-CoA reductase, and 3-hydroxyvaleryl-CoA dehydrogenase. In some embodiments, the ketoacyl-CoA reductase comprises an amino acid sequence of at least 70% homology to any one of SEQ ID NO 183 and SEQ ID NO 271. In some embodiments, the hydroxyacyl-CoA dehydratase is selected from the group consisting of a 3-hydroxybutyryl-CoA dehydratase and an enoyl-CoA hydratase. In some embodiments, the hydroxyacyl-CoA dehydratase comprises an amino acid sequence of at least 70% homology to any one of SEQ ID NO 183 and SEQ ID NO 272. In some embodiments, the enoyl-CoA reductase is trans-2-enoyl-reductase. In some embodiments, the enoyl-CoA reductase comprises an amino acid sequence of at least 70% homology to SEQ ID NO 275. In some embodiments, the 3-ketoacyl-CoA synthase comprises a modified NphT7 polypeptide comprising one or more amino acid substitutions selected from the group consisting of a PDRP to HFLQ substitution for amino acids 86-89, F217A, F217E, F217G, F217I, F217L, F217M, F217P, F217S, F217T, F217V, F217W, G288S, G309S, I147A, I147C, I147D, I147E, I147F, I147G, I147H, I147K, I147L, I147M, I147N, I147P, I147Q, I147R, I147S, I147T, I147V, I147W, I147Y, V157F, V196G, and Y144L. In some embodiments, the 3-ketoacyl-CoA synthase comprises a modified NphT7 polypeptide comprising two amino acid substitutions selected from the group consisting of I147T and F217V, I147T and Y144L, I147T and V196G, I147F and F217V, I147M and F217V, I147S and F217V, I147T and HFLQ, I147T and V157F, I147T and F217G, I147T and F217A, I147T and F217L, I147T and F217I, I147T and F217M, I147T and F217P, I147T and F217S, I147T and F217E, I147S and F217G, I147S and F217A, I147S and F217L, I147S and F217I, I147S and F217M, I147S and F217W, I147S and F217S, I147S and F217E, I147S and F217K, I147F and F217A, I147F and F217L, I147F and F217I, I147F and F217M, I147F and F217P, I147F and F217E, I147M and F217G, I147M and F217A, I147M and F217L, I147M and F217I, I147M and F217M, I147M and F217P, I147M and F217S, I147M and F217E, and I147M and F217K. In some embodiments, the 3-ketoacyl-CoA synthase comprises a modified NphT7 polypeptide comprising three amino acid substitutions selected from the group consisting of Y144L, I147T, and F217V; I147T, F217V, and HFLQ; I147T, V157F, and F217V; and Y144L, I147T, and V157F. In some embodiments, the 3-ketoacyl-CoA synthase comprises a modified NphT7 polypeptide comprising one or more amino acid substitutions at a position selected from the group consisting of Ser84, Val114, Gly288, Ile194, Gly318, Thr85, Gln90, Val196, Tyr144, Phe159, Ile147, and Phe217. In some embodiments, the ketoacyl-CoA reductase is selected from the group consisting 3-ketoacyl-CoA reductase and 3-hydroxyacyl-CoA dehydrogenase. In some embodiments, the ketoacyl-CoA reductase comprises an amino acid sequence of at least 70% homology to any one of SEQ ID NO 183 and SEQ ID NO 271. In some embodiments, the hydroxyacyl-CoA dehydratase is selected from the group consisting of a 3-hydroxyacyl-CoA dehydratase and enoyl-CoA hydratase. In some embodiments, the hydroxyacyl-CoA dehydratase comprises an amino acid sequence of at least 70% homology to any one of SEQ ID NO 183, and SEQ ID NO 272. In some embodiments, the enoyl-CoA reductase is trans-2-enoyl-reductase. In some embodiments, the enoyl-CoA reductase comprises an amino acid sequence of at least 70% homology to SEQ ID NO 275. In some embodiments, the genetically modified organism further comprises a heterologous nucleic acid sequence encoding a thioesterase or a wax ester synthase. In some embodiments, the genetically modified organism further comprises a heterologous nucleic acid sequence encoding a termination enzyme that catalyzes the production of a fatty acid-derived product selected from the group comprising a fatty alcohol, a fatty aldehyde, a fatty alkene, a fatty amide, a fatty alkane, and a fatty diacid. In some embodiments, the thioesterase is an acyl-CoA esterase and the organism is capable of producing a fatty acid. In some embodiments, the thioesterase is selected from the group comprising tesA, 'tesA, tesB, yciA, ybgC, ybfF, fadM, AtTE, CpTE, CperfTE, LpTE, and PA2801TE. In some embodiments, the thioesterase comprises an amino acid sequence of at least 70% homology to any one of SEQ ID NO 277, SEQ ID NO 278, SEQ ID NO 279, SEQ ID NO 280, SEQ ID NO 281, SEQ ID NO 282, SEQ ID NO 283, SEQ ID NO 284, SEQ ID NO 285, SEQ ID NO 286, SEQ ID NO 287, and SEQ ID NO 288. In some embodiments, the wax ester synthase is selected from the group comprising Maq1, Pcry1, Rjos1, and Abork1, and wherein said organism is capable of producing a fatty ester. In some embodiments, the wax ester synthase comprises an amino acid sequence of at least 70% homology to any one of SEQ ID NO 289, SEQ ID NO 290, SEQ ID NO 291, and SEQ ID NO 292, and wherein said organism is capable of producing a fatty ester. In some embodiments, the 3-ketoacyl-CoA synthase is NphT7; the keto-CoA reductase is selected from the group consisting of hbd and fadB; the 3-hydroxy-acyl-CoA dehydratase is selected from the group consisting of crt and fadB; the enoyl-CoA reductase is ter; and the thioesterase is selected from the group consisting of CpTE, fadM, PA2801TE, tesB, ybgC, ybfF, and yciA, and wherein the proteins encoded by the polynucleotides are capable of producing a four or five carbon fatty acid or fatty acid derived product. In some embodiments, the thioesterase is selected from the group consisting of tesB and yciA. In some embodiments, one or more 3-ketoacyl-CoA synthases are selected from the group consisting of NphT7, NphT7 I147T, NphT7 F217V, and NphT7 I147T, F217V; the keto-CoA reductase is fadB; the 3-hydroxy-acyl-CoA dehydratase is fadB; the enoyl-CoA reductase is ter; and the thioesterase is selected from the group consisting of AtTE, CpTE, CperfTE, PA2801TE, tesA, tesB, ybfF, ybgC, and yciA, and wherein the proteins encoded by the polynucleotides are capable of producing a six or seven carbon fatty acid or fatty acid derived product. In some embodiments, the thioesterase is selected from the group consisting of PA2801TE, tesB, and yciA. In some embodiments, one or more 3-ketoacyl-CoA synthases are selected from the group consisting of NphT7, NphT7 I147T, NphT7 F217V, NphT7 I147T and F217V, Npth7 I147S, Npth7 I147S and F217V, and synthase III; the keto-CoA reductase is selected from the group consisting of fadB and fabG; the 3-hydroxy-acyl-CoA dehydratase is selected from the group consisting of fadB, ech and ech2; the enoyl-CoA reductase is ter; and the thioesterase is selected from the group consisting of AtTE, CpTE, CperfTE, fadM, PA2801TE, tesA, tesB, ybfF, ybgC, and yciA; and wherein the proteins encoded by the polynucleotides are capable of producing an eight or nine carbon fatty acid or fatty acid derived product. In some embodiments, the thioesterase is selected from the group consisting of PA2801TE, tesB, and yciA. In some embodiments, one or more 3-ketoacyl-CoA synthases are selected from the group consisting of NphT7, NphT7 I147T, NphT7 F217V, NphT7 I147T and F217V, Npth7 I147S, Npth7 I147S and F217V, synthase III, synthase IV, and synthase V; the keto-CoA reductase is selected from the group consisting of fadB and fabG; the 3-hydroxy-acyl-CoA dehydratase is selected from the group consisting of fadB, ech and ech2; the enoyl-CoA reductase is ter; and the thioesterase is selected from the group consisting of AtTE, CpTE, fadM, PA2801TE, tesA, tesB, ybfF, ybgC, and yciA, and wherein the proteins encoded by the polynucleotides are capable of producing a ten or eleven carbon fatty acid or fatty acid derived product. In some embodiments, the thioesterase is selected from the group consisting of tesB and yciA. In some embodiments, one or more 3-ketoacyl-CoA synthases are selected from the group consisting of NphT7, NphT7 I147T, NphT7 F217V, NphT7 I147T and F217V, Npth7 I147S, Npth7 I147S and F217V, synthase III, synthase IV, synthase V, and synthase VI; the keto-CoA reductase is selected from the group consisting of fadB, fabG, and fadJ, the 3-hydroxy-acyl-CoA dehydratase is selected from the group consisting of fadB, ech, and fadJ; the enoyl-CoA reductase is ter; and the thioesterase is selected from the group consisting of AtTE, CpTE, CperfTE, fadM, LpTE, PA2801TE, tesA, tesB, ybfF, ybgC, and yciA, and wherein the proteins encoded by the polynucleotides are capable of producing a twelve or thirteen carbon fatty acid or fatty acid derived product. In some embodiments, the thioesterase is selected from the group consisting of fadM, PA2801TE, tesA, tesB, and yciA. In some embodiments, one or more 3-ketoacyl-CoA synthases are selected from the group consisting of NphT7, NphT7 I147T, NphT7 F217V, NphT7 I147T and F217V, Npth7 I147S, Npth7 I147S and F217V, synthase III, synthase IV, synthase V, and synthase VI; the keto-CoA reductase is selected from the group consisting of fadB, and fadJ; the 3-hydroxy-acyl-CoA dehydratase is selected form the group consisting of fadB, and fadJ; the enoyl-CoA reductase is selected from the group consisting of ter, ydiO and fadE; and the thioesterase is selected from the group consisting of AtTE, CpTE, CperfTE, fadM, LpTE, PA2801TE, tesA, tesB, ybfF, ybgC, and yciA, and wherein the proteins encoded by the polynucleotides are capable of producing a fatty acid with a carbon chain length of at least fourteen carbons. In some embodiments, the thioesterase is selected from the group consisting of fadM, tesA, tesB, and yciA, and the proteins encoded by the polynucleotides are capable of producing a fourteen or fifteen carbon fatty acid or fatty acid derived product. In some embodiments, the thioesterase is selected from the group consisting of AtTE, CpTE, CperfTE, fadM, Pa2801TE, tesA, tesB, ybfF, ybgC, and yciA, and the proteins encoded by the polynucleotides are capable of producing a sixteen or seventeen carbon fatty acid or fatty acid derived product. In some embodiments, the thioesterase is selected from the group consisting of AtTE, fadM, tesA, tesB, ybfF, ybgC, and yciA, and the proteins encoded by the polynucleotides are capable of producing a sixteen or seventeen carbon fatty acid or fatty acid derived product. In some embodiments, the organism is capable of using acetyl-CoA as a primer and malonyl-CoA as the extender molecule to produce a fatty acid or fatty acid derived product have a carbon chain length selected from 4, 6, 8, 10, 12, 14, 16, 18 and 20. In some embodiments, the organism is capable of using propionyl-CoA as a primer and malonyl-CoA as the extender molecule to produce a fatty acid or fatty acid derived product have a carbon chain length selected from 5, 7, 9, 11, 13, 15, 17, 19, and 21.

In one aspect, the disclosure provides for a modified NphT7 polypeptide, comprising an amino acid sequence having at least 70% homology to SEQ ID NO:1 and one or more amino acid substitutions, deletions, or insertions, wherein the modified NphT7 polypeptide is capable of accepting an acyl-CoA substrate having a carbon chain length of C4 or greater. In some embodiments, the modified NphT7 polypeptide is capable of catalyzing a condensation reaction to condense an acyl-CoA substrate with a malonyl-CoA to produce a 3-keto-acyl-CoA having a carbon chain length of C6 or greater. In some embodiments, a modified NphT7 polypeptide comprises one or more amino acid substitutions selected from the group consisting of I147T, F217V, Y144L, V157F, G309S, G288S, a PDRP to HFLQ substitution for amino acids 86-89, I147F, I147M, I147Q, I147S, I147C, I147E, I147N, I147W, I147D, I147R, I147P, I147L, V196G, I147G, I147H, I147K, I147V, I147A, I147Y, F217G, F217A, F217L, F217I, F217M, F217T, F217P, F217S, F217E, F217L, F217W, and any combination thereof. In some embodiments, a modified NphT7 polypeptide comprises one amino acid substitution selected from the group consisting of I147V, I147F, I147M, I147Q, I147S, I147C, I147E, I147N, I147W, I147D, I147R, I147P, I147L, I147G, I147H, I147K, I147A, I147Y, and F217V. In some embodiments, a modified NphT7 polypeptide comprises two amino acid substitutions selected from the group consisting of I147T and F217V, I147T and Y144L, I147T and V196G, I147F and F217V, I147M and F217V, I147S and F217V, I147T and HFLQ, I147T and V157F, I147T and F217G, I147T and F217A, I147T and F217L, I147T and F217I, I147T and F217M, I147T and F217P, I147T and F217S, I147T and F217E, I147S and F217G, I147S and F217A, I147S and F217L, I147S and F217I, I147S and F217M, I147S and F217W, I147S and F217S, I147S and F217E, I147S and F217K, I147F and F217A, I147F and F217L, I147F and F217I, I147F and F217M, I147F and F217P, I147F and F217E, I147M and F217G, I147M and F217A, I147M and F217L, I147M and F217I, I147M and F217M, I147M and F217P, I147M and F217S, I147M and F217E, and I147M and F217K. In some embodiments, a modified NphT7 polypeptide comprises three amino acid substitutions selected from the group consisting of (Y144L, I147T, and F217V), (I147T, F217V, and HFLQ), (I147T, V147F, and F217V), and (Y144L, I147T, and V157F). In some embodiments, a modified NphT7 polypeptide comprises one or more amino acid substitutions at a position selected from the group consisting of Ser84, Val114, Gly288, Ile194, Gly318, Thr85, Gln90, Val196, Tyr144, Phe159, Ile147, Phe217, and any combination thereof. In some embodiments, a modified NphT7 polypeptide comprises an I147T amino acid substitution. In some embodiments, a modified NphT7 polypeptide comprises an F217V amino acid substitution. In some embodiments, a modified NphT7 polypeptide comprises two or more amino acid substitutions, deletions, or insertions. In some embodiments, a modified NphT7 polypeptide comprises an I147T amino acid substitution and an F217V amino acid substitution. In some embodiments, a modified polypeptide of is isolated and purified.

In one aspect the disclosure provides for an isolated and purified polynucleotide encoding a modified NphT7 polypeptide of the disclosure.

In one aspect the disclosure provides for an isolated and purified polynucleotide comprising a nucleic acid sequence having at least 70% but less than 100% or about 100% homology or complementarity to SEQ ID NO:2, wherein the polynucleotide encodes a modified NphT7 polypeptide of SEQ ID NO:1 having one or more amino acid substitutions, wherein the modified NphT7 polypeptide is capable of accepting an acyl-CoA substrate having a carbon chain length of C4 or greater. In some embodiments, an isolated and purified polynucleotide of encodes a modified NphT7 polypeptide capable of catalyzing a condensation reaction to condense an acyl-CoA substrate with a malonyl-CoA to produce a 3-ketoacyl-CoA having a carbon chain length of C6 or greater. In some embodiments, an isolated and purified polynucleotide encodes a modified NphT7 polypeptide comprising one or more amino acid substitutions selected from the group consisting of I147T, F217V, Y144L, V157F, G309S, G288S, a PDRP to HFLQ substitution for amino acids 86-89, I147F, I147M, I147Q, I147S, I147C, I147E, I147N, I147W, I147D, I147R, I147P, I147L, V196G, I147G, I147H, I147K, I147V, I147A, I147Y, F217G, F217A, F217L, F217I, F217M, F217T, F217P, F217S, F217E, F217L, F217W, and any combination thereof. In some embodiments, an isolated and purified polynucleotide encodes a modified NphT7 polypeptide comprising one amino acid substitution selected from the group consisting of I147V, I147F, I147M, I147Q, I147S, I147C, I147E, I147N, I147W, I147D, I147R, I147P, I147L, I147G, I147H, I147K, I147A, I147Y, and F217V. In some embodiments, an isolated and purified polynucleotide encodes a modified NphT7 polypeptide comprising two amino acid substitutions selected from the group consisting of I147T and F217V, I147T and Y144L, I147T and V196G, I147F and F217V, I147M and F217V, I147S and F217V, I147T and HFLQ, I147T and V157F, I147T and F217G, I147T and F217A, I147T and F217L, I147T and F217I, I147T and F217M, I147T and F217P, I147T and F217S, I147T and F217E, I147S and F217G, I147S and F217A, I147S and F217L, I147S and F217I, I147S and F217M, I147S and F217W, I147S and F217S, I147S and F217E, I147S and F217K, I147F and F217A, I147F and F217L, I147F and F217I, I147F and F217M, I147F and F217P, I147F and F217E, I147M and F217G, I147M and F217A, I147M and F217L, I147M and F217I, I147M and F217M, I147M and F217P, I147M and F217S, I147M and F217E, and I147M and F217K. In some embodiments, an isolated and purified polynucleotide encodes a modified NphT7 polypeptide comprising three amino acid substitutions selected from the group consisting of (Y144L, I147T, and F217V), (I147T, F217V, and HFLQ), (I147T, V147F, and F217V), and (Y144L, I147T, and V157F). In some embodiments, an isolated and purified polynucleotide encodes a modified NphT7 polypeptide comprising one or more amino acid substitutions at a position selected from the group consisting of Ser84, Val114, Gly288, Ile194, Gly318, Thr85, Gln90, Val196, Tyr144, Phe159, Ile147, Phe217, and any combination thereof. In some embodiments, an isolated and purified polynucleotide encodes a modified NphT7 polypeptide comprising an I147T amino acid substitution. In some embodiments, an isolated and purified polynucleotide encodes a modified NphT7 polypeptide comprising an F217V amino acid substitution. In some embodiments, an isolated and purified polynucleotide encodes a modified NphT7 polypeptide comprising two or more amino acid substitutions. In some embodiments, an isolated and purified polynucleotide encodes a modified NphT7 polypeptide, comprising an I147T amino acid substitution and an F217V amino acid substitution. In some embodiments, an isolated and purified polynucleotide is RNA. In some embodiments, an isolated and purified polynucleotide is an mRNA. In some embodiments, an isolated and purified polynucleotide is a DNA. In some embodiments, an isolated and purified polynucleotide is a cDNA. In some embodiments, vector comprises a polynucleotide of the disclosure. In some embodiments, a plasmid comprises a polynucleotide of the disclosure.

In one aspect, the disclosure provides for a method of selecting a 3-ketoacyl-CoA synthase as a candidate for condensing a malonyl-CoA with an acyl-CoA having a carbon chain length greater than C2, comprising: identifying a 3-ketoacyl-CoA synthase polypeptide comprising an amino acid sequence having at least 70% but less than 100% or about 100% homology to SEQ ID NO:1; and selecting the 3-ketoacyl-CoA synthase as a candidate for condensing an acyl-CoA having a carbon chain length greater than C2 with a malonyl-CoA, if the 3-ketoacyl-CoA synthase comprises one or more features selected from the group consisting of an (A/G)GGSR sequence motif, lack of a STPDXPQ sequence motif, and solely hydrophobic residues in the substrate binding site. In some embodiments, the method comprises selecting at least two 3-ketoacyl-CoA synthases, wherein each synthase III occupies a different branch of a phylogenetic tree.

In one aspect the disclosure provides for a library of NphT7 homologs selected by a method of the disclosure.

In one aspect the disclosure provides for an isolated NphT7 homolog, comprising an amino acid sequence having at least 70% but less than 100% homology to any one of SEQ ID NOs. 1-120.

In one aspect the disclosure provides for an isolated polynucleotide encoding a selected 3-ketoacyl-CoA synthase of the disclosure.

In one aspect the disclosure provides for a genetically modified organism expressing a selected 3-ketoacyl-CoA synthase of the disclosure.

In one aspect, the disclosure provides for a method of producing a genetically modified organism that expresses a selected 3-ketoacyl-CoA synthase of the disclosure, comprising transforming a microorganism with a polynucleotide of the disclosure.

In one aspect the disclosure provides for a genetically modified organism capable of producing a fatty acid or fatty acid-derived product having a carbon chain length of C6 or greater at a rate or titer above a control organism lacking the genetic modification, wherein the genetically modified organism does not comprise any one of SEQ ID NO:121, SEQ ID NO:122, and SEQ ID NO:123. In some embodiments, a genetically modified organism comprises a vector or plasmid of the disclosure. In some embodiments, the genetically modified organism is transformed with a vector or plasmid. In some embodiments, the genetically modified organism comprises a polynucleotide of the disclosure. In some embodiments, the genetically modified organism, expresses a modified polypeptide and/or polynucleotide of the disclosure. In some embodiments, the genetically modified organism, expresses an NphT7 homolog or a modified NphT7 polypeptide of the disclosure. In some embodiments, the genetically modified organism comprises a heterologous polypeptide capable of condensing a malonyl-CoA with an acyl-CoA having a carbon chain length greater than C2 to produce a 3-ketoacyl-CoA having a carbon chain length greater than C4. In some embodiments, the acyl-CoA is acetyl-CoA and the 3-ketoacyl-CoA is 3-ketobutyryl-CoA. In some embodiments, the acyl-CoA is acetyl-CoA and the 3-ketoacyl-CoA is 3-ketobutyryl-CoA. In some embodiments, the acyl-CoA is propionyl-CoA and the 3-ketoacyl-CoA is 3-ketovaleryl-CoA. In some embodiments, the genetically modified organism is capable of producing a free fatty acid or fatty acid-derived product with a carbon chain length C6, C8, C10, C12, C14, C16, C18, C20, or greater with >20, 30, 40, 50, 60, 70, 80, or 90% purity. In some embodiments, the genetically modified organism is capable of producing a free fatty acid or fatty acid-derived product at a rate of about 0.1 g/gDCW*hr, about 0.2 g/gDCW*hr, or greater. In some embodiments, the genetically modified organism further comprises an additional genetic modification that increases production rate of acyl-CoA. In some embodiments, the genetically modified organism, further comprises an additional genetic modification that increases production rate of malonyl-CoA. In some embodiments, the genetically modified organism, further comprise an additional genetic modification that inhibits a malonyl-ACP fatty acid synthesis pathway. In some embodiments, the genetically modified organism, further comprises an additional genetic modification reduces the conversion of malonyl-CoA to malonyl ACP. In some embodiments, the genetically modified organism, further comprises an additional genetic modification reduces the rate of condensation of malonyl-ACP with acetyl-ACP. In some embodiments, the genetically modified organism, further comprises one or more additional genetic modifications that fully or partially inhibit one or more reactions selected from the group consisting of glucose to methylglyoxal conversion, pyruvate to lactate conversion, acetyl-CoA to acetate conversion, acetyl-CoA to ethanol conversion, fatty acyl to acetyl-CoA conversion, and any combination thereof. In some embodiments, the genetically modified organism, comprises a polynucleotide encoding a 3-ketoacyl-CoA synthase that comprises an amino acid sequence of at least 70% but less than 100% or about 100% homology to any one of SEQ ID NOs. 1-120. In some embodiments, the genetically modified organism, comprises one or more heterologous polypeptides selected from the group consisting of keto-CoA reductase (KCR), 3-hydroxyacyl-CoA dehydratase (3HDh), enoyl CoA reductase (EnCR), thioesterase enzymes, and any combination thereof. In some embodiments, the genetically modified organism, comprises one or more heterologous KCR selected from the group consisting of fadB, fabG, fadJ, ech2, PhaB, PaFabG, and any combination thereof. In some embodiments, the genetically modified organism, comprises one or more heterologous 3HDh selected from the group consisting of fadB, fadJ, ech, ech2, crt, and any combination thereof. In some embodiments, the genetically modified organism, comprises one or more heterologous EnCR selected from the group consisting of ter, ccr, fadE, ydiO and any combination thereof. In some embodiments, the genetically modified organism, comprises one or more heterologous thioesterases selected from the group consisting of yciA, PA2801TE, ATTE, YbgC, tesA, YbfF, fadM, LpTE, CpTE (or CperfTE), and any combination thereof. In some embodiments, the genetically modified organism, comprises one or more heterologous 3-ketoacyl-CoA synthases selected from the group consisting of WT NphT7, NphT7 mutated at I147T, and NphT7 mutated at I147T and F217V, and any combination thereof, and at least one of: a heterologous fadB; a heterologous ter; and/or one or more thioesterases selected from the group consisting of tesA, yciA, PA2801TE, and any combination thereof. In some embodiments, the genetically modified organism, comprises one or more heterologous 3-ketoacyl-CoA synthases selected from the group consisting of WT NphT7, NphT7 mutated at I147T, NphT7 mutated at I147T and F217V, synthase III, and any combination thereof; and at least one of: one or more heterologous KCR selected from the group consisting of fadB and fabG; one or more heterologous 3HDh selected from the group consisting of fadB, ech and ech2; a heterologous ter; and/or one or more thioesterases selected from the group consisting of tesA, yciA, PA2801TE, and any combination thereof. In some embodiments, the genetically modified organism, comprises one or more heterologous 3-ketoacyl-CoA synthases selected from the group consisting of WT NphT7, NphT7 mutated at I147T, NphT7 mutated at I147T and F217V, synthase III, synthase IV, synthase V, and any combination thereof; and at least one of: one or more heterologous KCR selected from the group consisting of fadB and fabG; one or more heterologous 3HDh selected from the group consisting of fadB, ech and ech2; a heterologous ter; and/or one or more thioesterases selected from the group consisting of tesA, ATTE, YbgC, and any combination thereof. In some embodiments, the genetically modified organism, comprises one or more heterologous 3-ketoacyl-CoA synthases selected from the group consisting of WT NphT7, NphT7 mutated at I147T, NphT7 mutated at I147T and F217V, synthase III, synthase IV, synthase V, synthase VI, and any combination thereof; and at least one of: one or more heterologous KCR selected from the group consisting of fadB, fabG, fadJ, and any combination thereof; one or more heterologous 3HDh selected from the group consisting of fadB, fadJ, ech, and any combination thereof; a heterologous ter; and/or one or more thioesterases selected from the group consisting of tesA, ybgC, ybFF, and any combination thereof. In some embodiments, the genetically modified organism, comprises one or more heterologous 3-ketoacyl-CoA synthases selected from the group consisting of WT NphT7, NphT7 mutated at I147T, NphT7 mutated at I147T and F217V, synthase III, synthase IV, synthase V, synthase VI, and any combination thereof; and at least one of: one or more heterologous KCR selected from the group consisting of fadB and fadJ; one or more heterologous 3HDh selected from the group consisting of fadB and fadJ; one or more heterologous EnCR selected from the group consisting of ter, ydiO and fadE; and/or one or more thioesterases selected from the group consisting of tesA, fadM and any combination thereof. In some embodiments, the genetically modified organism, further comprises an additional genetic modification that reduces activity of one or more endogenous polypeptides selected from the group consisting of KCR, hbd, enoyl CoA reductase, thioesterase, and any combination thereof. In some embodiments, the genetically modified organism, further comprises an additional genetic modification that reduces activity of a temperature sensitive version of one or more endogenous polypeptides. In some embodiments, the genetically modified organism, comprises one or more vectors encoding a second genetic modification of the disclosure. In some embodiments, the genetically modified organism, comprises a heterologous transporter that can transport past a cell membrane a free fatty acid having a carbon chain length of C6 or greater. In some embodiments, the genetically modified organism, comprises a heterologous transporter that is an ABC transporter. In some embodiments, the genetically modified organism, comprises a fatty acid-derived product that is a fatty alcohol, a fatty aldehyde, a fatty alkene, a fatty amide, a fatty ester, a fatty alkane, or fatty diacid. In some embodiments, one or more of thioesterases are fully or partially knocked out, the thioesterases being selected from the group consisting of tesB, YciA, AtTE, CpTE, and any combination thereof. In some embodiments, the genetically modified organism is isolated and purified.

In one aspect the disclosure provides for a genetically modified organism having a genetic modification selected from the group consisting of F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI(ts)-(S241F)-zeoR, Atig::frt, AatoDAEB::frt, and AfadD::frt, and an additional genetic modification that increases synthesis of fatty acid from CoA substrates. In some embodiments, the genetically modified organism, comprises a deletion of a host gene, wherein the deletion results in increased malonyl-CoA production. In some embodiments, the genetically modified organism, comprises a deletion of one or more genes selected from the group consisting of lactate dehydrogenase, pyruvate formate lyase, methylglyoxal synthase, pyruvate oxidase, phosphotransacetylase acetate kinase, bifunctional acetyl-CoA reductase/ alcohol dehydrogenase, and any combination thereof. In some embodiments, the genetically modified organism of the disclosure, further comprises an additional genetic modification that is associated with one or more enzymes selected from the group consisting of ACP, fabI, fabB, fabH, fabD, fabF, fabG, fabA, fabZ, fabR, and any combination thereof. In some embodiments, he genetically modified organism of the disclosure, further comprises an additional genetic modification that is associated with one or more enzymes selected from the group consisting of udhA, pntAB, PDH, CoAA, panD, aceA, aceB, aceK, GAPDH, pyk, pyk, gltA, CS, bicA, GOGAT, gdh, can, cynT, cynS, puuC, aldA, aldB, yieP, yibD, pstS, BAAT, rhtA, mdtM, yddG, yebS, yeeO, dedA, ycaP, ytfL, ybbP, yegH, ykgH, ytfF, eamB, ydhP, ypjD, mdlB, acrD, ydcO, emrD, citT, citS, citM, citH, and any combination thereof. In some embodiments, the genetically modified organism of the disclosure, further comprises an additional genetic modification associated with an ACCase enzyme. In some embodiments, the genetically modified organism of the disclosure, further comprises an additional genetic modification that is associated with one or more enzymes selected from the group consisting of cscA, cscB, cscK, galP, galKf, and any combination thereof. In some embodiments, the genetically modified organism, further comprises an additional genetic modification that is associated with one or more enzymes selected from the group consisting of fadE, fadD, fadA, fadB, fadI, fadJ, ydiO, paaJ, yqeF, tig, atoD, atoA, atoE, atoB, and any combination thereof. In some embodiments, the genetically modified organism, further comprises an additional genetic modification that is associated with one or more enzymes selected from the group consisting of NphT7, SaFabH, BsFabH, PaFabH, MtFabH, FabH, PaFabG, fabG, hbd, crt, ech, ech2, ter, ccr, and any combination thereof. In some embodiments, the genetically modified organism, further comprises an additional genetic modification resulting in expression of a heterologous thioesterase. In some embodiments, the genetically modified organism any claim, comprises one or more heterologous thioesterases selected from the group consisting of tesA, 'tesA, tesB, yciA, ybgC, ybfF, fadM, AtTE, CpTE (or CperfTE), LpTE, Pa2801TE, and any combination thereof. In some embodiments, the genetically modified organism, further comprises an additional genetic modification resulting in expression of a heterologous wax ester synthase. In some embodiments, the genetically modified organism, comprises one or more heterologous wax ester synthases selected from the group consisting of Maq1, Pcry1, Rjos1, Abork1, and any combination thereof. In some embodiments, the genetically modified organism, further comprises an additional genetic modification that results in expression of one or more heterologous proteins selected from the group consisting of prpE, phaA, phaB, phaC, THNS, THNS", and any combination thereof. In some embodiments, the genetically modified organism is a microorganism. In some embodiments, the genetically modified organism is E. Coli.

In one aspect the disclosure provides for a method of producing from malonyl-CoA a free fatty acid that has a carbon chain length of C6 or greater comprising culturing a transformed microorganism with a carbon feed source, thereby producing the free fatty acid.

In one aspect the disclosure provides for a method of producing from malonyl-CoA a free fatty acid that has a carbon chain length of C6 or greater comprising: inducing expression of a polypeptide in a microorganism; and culturing a transformed microorganism with a carbon feed source, thereby producing the free fatty acid.

In one aspect the disclosure provides for a method of producing from malonyl-CoA a free fatty acid that has a carbon chain length of C6 or greater comprising: providing a genetically modified microorganism; and culturing a transformed microorganism with a carbon feed source, thereby producing the free fatty acid.

In one aspect the disclosure provides for a method of producing a free fatty acid that has a carbon chain length of C6 or greater comprising culturing a microorganism under conditions sufficient to increase acyl-CoA and malonyl-CoA production.

In one aspect the disclosure provides for a method of producing a free fatty acid that has a carbon chain length of C6 or greater, comprising culturing a microorganism under conditions sufficient to enable condensation of a malonyl-CoA and an acyl-CoA of a carbon chain length of C2 or greater, whereby the condensation results in production of a keto-acyl CoA product having a chain length of C6 or greater.

In one aspect the disclosure provides for a method of producing a free fatty acid that has a carbon chain length of C6 or greater, comprising culturing a microorganism under conditions sufficient to reduce a keto group in a keto-acyl CoA product having a carbon chain length of C6 or greater, hereby producing a hydroxyl-acyl-CoA product having a carbon chain length of C6 or greater.

In one aspect, the disclosure provides for a method of producing a free fatty acid that has a carbon chain length of C6 or greater, comprising culturing a microorganism under conditions sufficient to perform a dehydratase reaction of a hydroxyl-acyl-CoA producing having a carbon chain length of C6 or greater to produce an enoyl-acyl-CoA product having a carbon chain length of C6 or greater.

In one aspect, the disclosure provides a method of producing a free fatty acid that has a carbon chain length of C6 or greater, comprising culturing a microorganism under conditions sufficient to reduce an enoyl group of an enoyl-acyl-CoA product having a carbon chain length of C6 or greater to produce an acyl-CoA product having a carbon chain length of C6 or greater.

In one aspect the disclosure provides a method for a method of producing a free fatty acid that has a carbon chain length of C6 or greater, comprising culturing a microorganism under conditions sufficient to remove a CoA group from an acyl-CoA product having a carbon chain length of C6 or greater to produce a free fatty acid or fatty acid-derived product having a carbon chain length of C6 or greater.

In one aspect the disclosure provides for a method of producing a free fatty acid or fatty acid-derived product of chain length of C6 or greater from malonyl-CoA, comprising: culturing a genetically modified organism under conditions sufficient to increase acyl CoA and malonyl-CoA production, condensing the acyl CoA and malonyl-CoA in the genetically modified organism to produce a keto-acyl CoA product having a carbon chain length of C6 or greater; reducing a keto-group in the keto-acyl CoA product to product a hydroxyl-acyl-CoA product having a carbon chain length of C6 or greater; performing a dehydratase reaction on the hydroxyl-acyl-CoA product to produce an enoyl-acyl-CoA product having a carbon chain length of C6 or greater; and reducing an enoyl group of the enoyl-acyl-CoA product to produce an acyl-CoA product having a carbon chain length of C6 or greater; and removing a CoA group from the acyl-CoA product to produce the free fatty acid or fatty acid-derived product having a carbon chain length of C6 or greater. In some embodiments, at least 20%, 30%, 40%, 50%, 60%, 70%, 80%, or 90% of free fatty acids produced by a genetically modified organism comprise a carbon chain length of C6 or greater. In some embodiments, the method comprises culturing a genetically modified organism that comprises one or more heterologous 3-ketoacyl-CoA synthases selected from the group consisting of WT NphT7, NphT7 mutated at I147T, NphT7 mutated at I147T and F217V, and any combination thereof; and at least one of: a heterologous fadB; a heterologous ter; and/or one or more thioesterases selected from the group consisting of yciA and PA2801TE. In some embodiments, at least 20%, 30%, 40%, 50%, 60%, 70%, 80%, or 90% of free fatty acids produced by a genetically modified organism comprise a carbon chain length of C8 or greater. In some embodiments, the method further comprises culturing a genetically modified organism that comprises one or more heterologous 3-ketoacyl-CoA synthases selected from the group consisting of WT NphT7, NphT7 mutated at I147T, NphT7 mutated at I147T and F217V, synthase III, and any combination thereof; and at least one of: one or more heterologous KCR selected from the group consisting of fadB and fabG; one or more heterologous 3HDh selected from the group consisting of fadB, ech and ech2; a heterologous ter; and/or one or more thioesterases selected from the group consisting of tesA, yciA, PA2801TE, and any combination thereof. In some embodiments, at least 20%, 30%, 40%, 50%, 60%, 70%, 80%, or 90% of free fatty acids produced by a genetically modified organism comprise a carbon chain length of C10 or greater. In some embodiments, the method further comprises culturing a genetically modified organism that comprises one or more heterologous 3-ketoacyl-CoA synthases selected from the group consisting of WT NphT7, NphT7 mutated at I147T, NphT7 mutated at I147T and F217V, synthase III, synthase IV, synthase V, and any combination thereof; at least one of: one or more heterologous KCR selected from the group consisting of fadB and fabG; one or more heterologous 3HDh selected from the group consisting of fadB, ech and ech2; a heterologous ter; and/or one or more thioesterases selected from the group consisting of tesA, ATTE, YbgC, and any combination thereof. In some embodiments, at least 20%, 30%, 40%, 50%, 60%, 70%, 80%, or 90% of free fatty acids produced by a genetically modified organism comprise a carbon chain length of C12. In some embodiments, the method further comprises culturing a genetically modified organism that comprises one or more heterologous 3-ketoacyl-CoA synthases selected from the group consisting of WT NphT7, NphT7 mutated at I147T, NphT7 mutated at I147T and F217V, synthase III, synthase IV, synthase V, synthase VI, and any combination thereof; and at least one of: one or more heterologous KCR selected from the group consisting of fadB, fabG, fadJ, and any combination thereof; one or more heterologous 3HDh selected from the group consisting of fadB, fadJ, ech, and any combination thereof; a heterologous ter; and/or one or more thioesterases selected from the group consisting of tesA, ybgC, ybFF, and any combination thereof. In some embodiments, at least 50%, 60%, 70%, 80%, or 90% of free fatty acids produced by a genetically modified organism comprise a carbon chain length of C14 or C16. In some embodiments, the method further comprises culturing a genetically modified organism that comprises one or more heterologous 3-ketoacyl-CoA synthases selected from the group consisting of WT NphT7, NphT7 mutated at I147T, NphT7 mutated at I147T and F217V, synthase III, synthase IV, synthase V, synthase VI, and any combination thereof; and at least one of: one or more heterologous KCR selected from the group consisting of fadB and fadJ; one or more heterologous 3HDh selected from the group consisting of fadB and fadJ; one or more heterologous EnCR selected from the group consisting of ter, ydiO and fadE; and/or one or more thioesterases selected from the group consisting of tesA, fadM, and any combination thereof. In some embodiments, the method further comprises a cycle that comprises reactions, wherein the cycle comprises reactions employing: a NphT7, a KCR, a 3HDh, and an EnCR, wherein at least one, two, three, four, five, six, seven, eight, or nine cycles are conducted, and at least one of the NphT7, KCR, 3HDh, and/or EnCR is modified.

In one aspect the disclosure provides for a free fatty acid or fatty acid-derived product produced from a genetically modified organism.

In one aspect the disclosure provides for a free fatty acid or fatty acid-derived product produced by a method of the disclosure. In some embodiments, the fatty acid-derived product is a fatty alcohol, fatty amide, fatty ester, fatty aldehyde, fatty alkene, fatty alkane, or fatty diacid, each of which is substituted or unsubstituted.

In one aspect the disclosure provides for use of a genetically modified organism for producing a fatty acid having a carbon chain length of C6 or greater.

In one aspect the disclosure provides for a system for producing a free fatty acid or fatty acid-derived product comprising a carbon chain length of C6 or greater comprising: one or more genetically modified organisms and/or modified polypeptides; and an incubator configured for culturing the one or more genetically modified organisms. In some embodiments, the system comprises a culture medium that comprises a carbon feed source. In some embodiments, the system comprises a purification system for purifying a free fatty acid or fatty acid-derived product. In some embodiments, the system comprises at least two strains of genetically modified organisms. In some embodiments, the system comprises at least three strains of genetically modified organisms. In some embodiments, the system is capable of producing a free fatty acid or fatty acid-derived product at a titer of about 5 g/L, about 10 g/L, or greater. In some embodiments, the system is capable of producing a free fatty acid or fatty acid-derived product comprising a carbon chain of C6 or greater at a concentration of about 0.5 g/L or greater. In some embodiments, the system is capable of producing a free fatty acid or fatty acid-derived product comprising a C12 carbon chain at a concentration of about 0.7 g/L or greater. In some embodiments, the system is capable of producing a free fatty acid or fatty acid-derived product comprising a C14 carbon chain at a concentration of about 0.7 g/L or greater. In some embodiments, the system is capable of producing a free fatty acid or fatty acid-derived product comprising a C16 carbon chain at a concentration of about 0.8 g/L or greater. In some embodiments, the system is capable of yielding a free fatty acid or fatty acid-derived product at about 0.125 g/g, about 0.16 g/g, or greater. In some embodiments, the system further comprises a mixing apparatus. In some embodiments, the system further comprises a heating apparatus, wherein the incubator comprises the heating apparatus. In some embodiments, the system further comprises a reservoir. In some embodiments, the system further comprises a pump. In some embodiments, the system the reservoir is operably connected to the incubator, and wherein the pump is operably configured to pump material from the reservoir to the incubator. In some embodiments, the system further comprises a lysing apparatus. In some embodiments, the system further comprises an extracting apparatus. In some embodiments, the system further comprises a distillation apparatus.

In one aspect the disclosure provides for a genetically modified organism that is *Clostridium, Zymomonas, Escherichia, Salmonella, Rhodococcus, Pseudomonas, Streptomyces, Bacillus, Lactobacillus, Enterococcus, Alcaligenes, Klebsiella, Paenibacillus, Arthrobacter, Corynebacterium, Brevibacterium, Pichia, Candida, Hansenula, Thraustochytrids, Bacteriophage,* or *Saccharomyces*. In some embodiments, the genetically modified organism is a prokaryotic cell. In some embodiments, the genetically modified organism is a eukaryotic cell. In some embodiments, the genetically modified organism is a yeast cell. In some embodiments, the genetically modified organism is a bacteria cell. In some embodiments, the genetically modified organism is a fungi cell. In some embodiments, the genetically modified organism is a microalgae cell. In some embodiments, the genetically modified organism is an algae cell.

In one aspect the disclosure provides for a carbon source comprising a C6 carbon source. In some embodiments, the carbon source comprises a C3 carbon source. In some embodiments, the carbon source comprises one or more cellulosic sugars. In some embodiments, the carbon source comprises glucose, sucrose, fructose, dextrose, lactose, xylose, or any combination thereof. In some embodiments, the carbon source comprises less than about 50%, 40%, 30%, 20%, 10%, or 5% by mass of glycerol.

In one aspect the disclosure provides for a biomass comprising a genetically modified organism. In some embodiments, the biomass comprises a lysed genetically modified organism. In some embodiments, the biomass comprises a modified NphT7 polypeptide. In some embodiments, the biomass comprises a modified polypeptide. In some embodiments, the biomass comprises a polynucleotide. In some embodiments, the biomass comprises a free fatty acid or fatty acid-derived product. In some embodiments, the biomass is dehydrated.

In one aspect the disclosure provides for a broth comprising a genetically modified organism. In one aspect the disclosure provides for a broth comprising a lysed genetically modified organism. In one aspect the disclosure provides for a broth comprising a modified NphT7 polypeptide. In one aspect the disclosure provides for a broth comprising a modified polypeptide. In one aspect the disclosure provides for a broth comprising a polynucleotide of the disclosure. In one aspect the disclosure provides for a broth comprising a free fatty acid or fatty acid-derived product of the disclosure.

In one aspect the disclosure provides for an acyl-CoA product, comprising about 15% to 50% by mass of acyl-CoA having a carbon chain length of C4. In one aspect the disclosure provides for an acyl-CoA product, comprising about 40% to 50% by mass of acyl-CoA having a carbon chain length of C6. In one aspect the disclosure provides for an acyl-CoA product, comprising about 5% to 30% by mass of acyl-CoA having a carbon chain length of C8. In one aspect the disclosure provides for an acyl-CoA product, comprising about 1% to 20% by mass of acyl-CoA having a carbon chain length of C12. In one aspect the disclosure provides for an acyl-CoA product, wherein the mass ratio of acyl-CoA having a carbon chain length of C4, acyl-CoA having a carbon chain length of C6, acyl-CoA having a carbon chain length of C8, and acyl-CoA having a carbon chain length of C12, is about 2:4:2:1. In one aspect the disclosure provides for an acyl-CoA product, wherein the mass ratio of acyl-CoA having a carbon chain length of C4, acyl-CoA having a carbon chain length of C6, and acyl-CoA having a carbon chain length of C8, is about 7:8:1. In one aspect the disclosure provides for an acyl-CoA product, wherein the mass ratio of acyl-CoA having a carbon chain length of C4, acyl-CoA having a carbon chain length of C6, acyl-CoA having a carbon chain length of C8, and acyl-CoA having a carbon chain length of C12, is about 2:1:1:1. In one aspect the disclosure provides for an acyl-CoA product, wherein the mass ratio of acyl-CoA having a carbon chain length of C4, acyl-CoA having a carbon chain length of C6, acyl-CoA having a carbon chain length of C8, and acyl-CoA having a carbon chain length of C12, is about 8:2:3:1. In some embodiments, the acyl-CoA product is selected from the group consisting of 3-ketoacyl-CoA, 3-hydroxyacyl-CoA, and enoyl-CoA.

In one aspect the disclosure provides for a free fatty acid or fatty acid-derived product, comprising about 15% to 50 by mass of a free fatty acid or fatty acid-derivative having a carbon chain length of C4. In one aspect the disclosure provides for a free fatty acid or fatty acid-derived product, comprising about 40% to 50% by mass of a free fatty acid or fatty acid-derivative having a carbon chain length of C6. In one aspect the disclosure provides for a free fatty acid or fatty acid-derived product, comprising about 5% to 30% by mass of a free fatty acid or fatty acid-derivative having a carbon chain length of C8. In one aspect the disclosure provides for a free fatty acid or fatty acid-derived product, comprising about 1% to 20% by mass of a free fatty acid or fatty acid-derivative having a carbon chain length of C12. In one aspect the disclosure provides for a free fatty acid or fatty acid-derived product, wherein the mass ratio of a free fatty acid or fatty acid-derivative having a carbon chain length of C4, a free fatty acid or fatty acid-derivative having a carbon chain length of C6, a free fatty acid or fatty acid-derivative having a carbon chain length of C8, and acyl-CoA having a carbon chain length of C12, is about 2:4:2:1. In one aspect the disclosure provides for a free fatty acid or fatty acid-derived product, wherein the mass ratio of a free fatty acid or fatty acid-derivative having a carbon chain length of C4, a free fatty acid or fatty acid-derivative having a carbon chain length of C6, and a free fatty acid or fatty acid-derivative having a carbon chain length of C8, is about 7:8:1. In one aspect the disclosure provides for a free fatty acid or fatty acid-derived product, wherein the mass ratio of a free fatty acid or fatty acid-derivative having a carbon chain length of C4, a free fatty acid or fatty acid-derivative having a carbon chain length of C6, a free fatty acid or fatty acid-derivative having a carbon chain length of C8, and a free fatty acid or fatty acid-derivative having a carbon chain length of C12, is about 2:1:1:1. In one aspect the disclosure provides for a free fatty acid or fatty acid-derived product, wherein the mass ratio of a free fatty acid or fatty acid-derivative having a carbon chain length of C4, a free fatty acid or fatty acid-derivative having a carbon chain length of C6, a free fatty acid or fatty acid-derivative having a carbon chain length of C8, and a free fatty acid or fatty acid-derivative having a carbon chain length of C12, is about 8:2:3:1. In one aspect the disclosure provides for a free fatty acid or fatty acid-derived product, comprising about 16% or greater mass of a free fatty acid or fatty acid-derivative having a carbon chain length of C14. In one aspect the disclosure provides for a free fatty acid or fatty acid-derived product, comprising about 20% or greater mass of a free fatty acid or fatty acid-derivative having a carbon chain length of C16. In one aspect the disclosure provides for a free fatty acid or fatty acid-derived product, comprising about 36% or greater mass of a free fatty acid or fatty acid-derivative having a carbon chain length of C14 or C16. In one aspect the disclosure provides for a free fatty acid or fatty acid-derived product, comprising about 60% or greater mass of a free fatty acid or fatty acid-derivative having a carbon chain length of C14 or C16. In one aspect the disclosure provides for a free fatty acid or fatty acid-derived product, wherein the mass ratio of a free fatty acid or fatty acid-derivative having a carbon chain length of C4, a free fatty acid or free fatty acid-derivative having a carbon chain length of C6, a free fatty acid or fatty acid-derivative having a carbon chain length of C8, a free fatty acid or fatty acid-derivative having a carbon chain length of C10, a free fatty acid or fatty acid-derivative having a carbon chain length of C12, a free fatty acid having a carbon chain length of C14, a free fatty acid or fatty acid-derivative having a carbon chain length of C16, and a free fatty acid or fatty acid-derivative having a carbon chain length of C18, is about 10:20:12:7:8:16:20:7, or about 1:2:1:1:1:2:2:1. In one aspect the disclosure provides for an acyl-CoA product, free fatty acid product, or fatty acid-derived product, that is isolated and purified.

In one aspect the disclosure provides for a method of making one or more fatty acid-derived products selected from the group consisting of fatty ester, fatty amide, fatty alcohol, fatty aldehyde, fatty alkene, fatty alkane, fatty diacid, and any combination thereof, comprising: contacting a carbon source with a microorganism to form a free fatty acid having a carbon chain length of C6 or greater; and converting the free fatty acid to the fatty acid-derived product, wherein the fatty acid-derived product comprises a carbon chain length of C6 or greater. In one aspect the disclosure provides for a method of making an ester of a fatty acid, comprising esterifying a fatty acid produced by a genetically modified organism. In one aspect the disclosure provides for a method of making an amide of a fatty acid, comprising forming an amide of a fatty acid produced by a genetically modified organism of the disclosure. In one aspect the disclosure provides for a method of making a fatty alcohol, comprising forming the fatty alcohol from the fatty acid produced by a genetically modified organism of the disclosure. In one aspect the disclosure provides for a method of making an aldehyde of a fatty acid, comprising forming an aldehyde of a fatty acid produced by a genetically modified organism of the disclosure.

In one aspect the disclosure provides for a fuel comprising the acyl-CoA product, free fatty acid product, or fatty-acid derived product of the disclosure. In one aspect the disclosure provides for a lotion comprising the acyl-CoA product, free fatty acid product, or fatty-acid derived product of the disclosure. In one aspect the disclosure provides for a soap comprising the acyl-CoA product, free fatty acid product, or fatty-acid derived product of the disclosure. In one aspect the disclosure provides for a food comprising the acyl-CoA product, free fatty acid product, or fatty-acid derived product of the disclosure. In one aspect the disclosure provides for a cream comprising the acyl-CoA product, free fatty acid product, or fatty-acid derived product of the disclosure. In one aspect the disclosure provides for a shampoo comprising the acyl-CoA product, free fatty acid product, or fatty-acid derived product of the disclosure. In one aspect the disclosure provides for a conditioner comprising the acyl-CoA product, free fatty acid product, or fatty-acid derived product of the disclosure. In one aspect the disclosure provides for a cleaner comprising the acyl-CoA product, free fatty acid product, or fatty-acid derived product of the disclosure. In one aspect the disclosure provides for a detergent comprising the acyl-CoA product, free fatty acid product, or fatty-acid derived product of the disclosure. In one aspect the disclosure provides for a lubricant comprising the acyl-CoA product, free fatty acid product, or fatty-acid derived product of the disclosure. In one aspect the disclosure provides for a paint comprising the acyl-CoA product, free fatty acid product, or fatty-acid derived product of the disclosure. In one aspect the disclosure provides for a stain comprising the acyl-CoA product, free fatty acid product, or fatty-acid derived product of the disclosure. In one aspect the disclosure provides for an ink comprising the acyl-CoA product, free fatty acid product, or fatty-acid derived product of the disclosure. In one aspect the disclosure provides for a pharmaceutical formulation comprising the acyl-CoA product, free fatty acid product, or fatty-acid derived product of the disclosure. In some embodiments, the product further comprises one or more active agents. In some embodiments, the product further comprises an excipient.

In one aspect the disclosure provides for one or more isolated and purified polynucleotides comprising exogenous nucleic acid molecules encoding proteins comprising an acetoacetyl CoA synthase, a keto-CoA reductase, a 3-hydroxy-acyl-CoA dehydratase, an enoyl-CoA reductase, and a thioesterase, wherein the 3-ketoacyl-CoA synthase is selected from the group consisting of NphT7, NphT7 I147T, NphT7 F217V, NphT7 I147T and F217V, Npth7 I147S, Npth7 I147S and F217V, synthase III, synthase IV, synthase V, and synthase VI; the keto-CoA reductase is selected from the group consisting of hbd, fadB, fabG and fadJ the 3-hydroxy-acyl-CoA dehydratase is selected from the group consisting of crt, ech, fadB, and fadJ; the enoyl-CoA reductase is selected from the group consisting of ter, ydiO and fadE; and the thioesterase is selected from the group consisting of AtTE, CpTE (or CperfTE), fadM, LpTE, PA2801TE, tesA, tesB, ybfF, ybgC, and yciA. In some embodiments, the 3-ketoacyl-CoA synthase is NphT7; the keto-CoA reductase is selected from the group consisting of hbd and fadB; the 3-hydroxy-acyl-CoA dehydratase is selected from the group consisting of crt and fadB; the enoyl-CoA reductase is ter; and the thioesterase is yciA, and wherein the proteins encoded by the polynucleotides are capable of producing a four carbon fatty acid or fatty acid derived product. In some embodiments, the thioesterase is selected from the group consisting of tesB and yciA. In some embodiments, the 3-ketoacyl-CoA synthase is NphT7 and wherein the proteins encoded by the polynucleotides are capable of producing a four carbon fatty acid or fatty acid derived product. In some embodiments, the keto-CoA reductase is selected from the group consisting of hbd and fadB, and wherein the proteins encoded by the polynucleotides are capable of producing a four carbon fatty acid or fatty acid derived product. In some embodiments, the 3-hydroxy-acyl-CoA dehydratase is selected from the group consisting of crt and fadB, and wherein the proteins encoded by the polynucleotides are capable of producing a four carbon fatty acid or fatty acid derived product. In some embodiments, the enoyl-CoA reductase is ter, and wherein the proteins encoded by the polynucleotides are capable of producing a four carbon fatty acid or fatty acid derived product. In some embodiments, the thioesterase is selected from the group consisting of CpTE, fadM, PA2801TE, tesB, ybgC, ybfF, and yciA, and wherein the proteins encoded by the polynucleotides are capable of producing a four carbon fatty acid or fatty acid derived product. In some embodiments, the thioesterase is selected from the group consisting of tesB and yciA, and wherein the proteins encoded by the polynucleotides are capable of producing a four carbon fatty acid or fatty acid derived product. In some embodiments, one or more 3-ketoacyl-CoA synthases are selected from the group consisting of NphT7, NphT7 I147T, NphT7 F217V, and NphT7 I147T, F217V; the keto-CoA reductase is fadB; the 3-hydroxy-acyl-CoA dehydratase is fadB; the enoyl-CoA reductase is ter; and the thioesterase is selected from the group consisting of AtTE, CpTE (or CperfTE), PA2801TE, tesA, tesB, ybfF, ybgC, and yciA, and wherein the proteins encoded by the polynucleotides are capable of producing a six carbon fatty acid or fatty acid derived product. In some embodiments, the thioesterase is selected from the group consisting of PA2801TE, tesB, and yciA. In some embodiments, one or more 3-ketoacyl-CoA synthases are selected from the group consisting of NphT7, NphT7 I147T, NphT7 F217V, and NphT7 I147T and F217V, and wherein the proteins encoded by the polynucleotides are capable of producing a six carbon fatty acid or fatty acid derived product. In some embodiments, the keto-CoA reductase is fadB, and wherein the proteins encoded by the polynucleotides are capable of producing a six carbon fatty acid or fatty acid derived product. In some embodiments, the 3-hydroxy-acyl-CoA dehydratase is fadB, and wherein the proteins encoded by the polynucleotides are capable of producing a six carbon fatty acid or fatty acid derived product. In some embodiments, the enoyl-CoA reductase is ter, and wherein the proteins encoded by the polynucleotides are capable of producing a six carbon fatty acid or fatty acid derived product. In some embodiments, the thioesterase is selected form the group consisting of AtTE, CpTE (or CperfTE), PA2801TE, tesA, tesB, ybfF, ybgC, and yciA, and wherein the proteins encoded by the polynucleotides are capable of producing a six carbon fatty acid or fatty acid derived product. In some embodiments, the thioesterase is selected form the group consisting of PA2801TE, tesB, and yciA, and wherein the proteins encoded by the polynucleotides are capable of producing a six carbon fatty acid or fatty acid derived product. In some embodiments, one or more 3-ketoacyl-CoA synthases are selected from the group consisting of NphT7, NphT7 I147T, NphT7 F217V, NphT7 I147T and F217V, Npth7 I147S, Npth7 I147S and F217V, and synthase III; the keto-CoA reductase is selected from the group consisting of fadB and fabG; the 3-hydroxy-acyl-CoA dehydratase is selected from the group consisting of fadB, ech and ech2; the enoyl-CoA reductase is ter; and the thioesterase is selected from the group consisting of AtTE, CpTE (or CperfTE), fadM, PA2801TE, tesA, tesB, ybfF, ybgC, and yciA; and wherein the proteins encoded by the polynucleotides are capable of producing an eight carbon fatty acid or fatty acid derived product. In some embodiments, the thioesterase is selected from the group consisting of PA2801TE, tesB, and yciA. In some embodiments, one or more 3-ketoacyl-CoA synthases are selected from the group consisting of NphT7, NphT7 I147T, NphT7 F217V, NphT7 I147T and F217V, Npth7 I147S, Npth7 I147S and F217V, and synthase III, and wherein the proteins encoded by the polynucleotides are capable of producing an eight carbon fatty acid or fatty acid derived product. In some embodiments, the keto-CoA reductase is selected from the group consisting of fadB and fabG, and wherein the proteins encoded by the polynucleotides are capable of producing an eight carbon fatty acid or fatty acid derived product. In some embodiments, the 3-hydroxy-acyl-CoA dehydratase is selected form the group consisting of fadB, ech and ech2, and wherein the proteins encoded by the polynucleotides are capable of producing an eight carbon fatty acid or fatty acid derived product. In some embodiments, the enoyl-CoA reductase is ter, and wherein the proteins encoded by the polynucleotides are capable of producing an eight carbon fatty acid or fatty acid derived product. In some embodiments, the thioesterase is selected from the group consisting of AtTE, CpTE (or CperfTE), fadM, PA2801TE, tesA, tesB, ybfF, ybgC, and yciA, and wherein the proteins encoded by the polynucleotides are capable of producing an eight carbon fatty acid or fatty acid derived product. In some embodiments, the thioesterase is selected from the group consisting of PA2801TE, tesB, and yciA, and wherein the proteins encoded by the polynucleotides are capable of producing an eight carbon fatty acid or fatty acid derived product. In some embodiments, one or more 3-ketoacyl-CoA synthases are selected from the group consisting of NphT7, NphT7 I147T, NphT7 F217V, NphT7 I147T and F217V, Npth7 I147S, Npth7 I147S and F217V, synthase III, synthase IV, and synthase V; the keto-CoA reductase is selected from the group consisting of fadB and fabG; the 3-hydroxy-acyl-CoA dehydratase is selected from the group consisting of fadB, ech and ech2; the enoyl-CoA reductase is ter; and the thioesterase is selected from the group consisting of AtTE, CpTE, fadM, PA2801TE, tesA, tesB, ybfF, ybgC, and yciA, and wherein the proteins encoded by the polynucleotides are capable of producing a ten carbon fatty acid or fatty acid derived product. In some embodiments, the thioesterase is selected from the group consisting of tesB and yciA. In some embodiments, one or more 3-ketoacyl-CoA synthases are selected from the group consisting of NphT7, NphT7 I147T, NphT7 F217V, NphT7 I147T and F217V, Npth7 I147S, Npth7 I147S and F217V, synthase III, synthase IV, and synthase V, and wherein the proteins encoded by the polynucleotides are capable of producing a ten carbon fatty acid or fatty acid derived product. In some embodiments, the keto-CoA reductase is selected from the group consisting of fadB and fabG, and wherein the proteins encoded by the polynucleotides are capable of producing a ten carbon fatty acid or fatty acid derived product. In some embodiments, the 3-hydroxy-acyl-CoA dehydratase is selected from the group consisting of fadB, ech and ech2, and wherein the proteins encoded by the polynucleotides are capable of producing a ten carbon fatty acid or fatty acid derived product. In some embodiments, the enoyl-CoA reductase is ter, and wherein the proteins encoded by the polynucleotides are capable of producing a ten carbon fatty acid or fatty acid derived product. In some embodiments, the thioesterase is selected from the group consisting of AtTE, CpTE, fadM, PA2801TE, tesA, tesB, ybfF, ybgC, and yciA, and wherein the proteins encoded by the polynucleotides are capable of producing a ten carbon fatty acid or fatty acid derived product. In some embodiments, the thioesterase is selected from the group consisting of tesB and yciA, and wherein the proteins encoded by the polynucleotides are capable of producing a ten carbon fatty acid or fatty acid derived product. In some embodiments, one or more 3-ketoacyl-CoA synthases are selected from the group consisting of NphT7, NphT7 I147T, NphT7 F217V, NphT7 I147T and F217V, Npth7 I147S, Npth7 I147S and F217V, synthase III, synthase IV, synthase V, and synthase VI; the keto-CoA reductase is selected from the group consisting of fadB, fabG, and fadJ, the 3-hydroxy-acyl-CoA dehydratase is selected from the group consisting of fadB, ech, and fadJ; the enoyl-CoA reductase is ter; and the thioesterase is selected from the group consisting of AtTE, CpTE (or CperfTE), fadM, LpTE, PA2801TE, tesA, tesB, ybfF, ybgC, and yciA, and wherein the proteins encoded by the polynucleotides are capable of producing a twelve carbon fatty acid or fatty acid derived product. In some embodiments, the thioesterase is selected from the group consisting of fadM, PA2801TE, tesA, tesB, and yciA. In some embodiments, one or more 3-ketoacyl-CoA synthases are selected from the group consisting of NphT7, NphT7 I147T, NphT7 F217V, NphT7 I147T and F217V, Npth7 I147S, Npth7 I147S and F217V, synthase III, synthase IV, synthase V, and synthase VI, and wherein the proteins encoded by the polynucleotides are capable of producing a twelve carbon fatty acid or fatty acid derived product. In some embodiments, the keto-CoA reductase is selected form the group consisting of fadB, fabG, and fadJ, and wherein the proteins encoded by the polynucleotides are capable of producing a twelve carbon fatty acid or fatty acid derived product. In some embodiments, the 3-hydroxy-acyl-CoA dehydratase is selected from the group consisting of fadB, ech, and fadJ, and wherein the proteins encoded by the polynucleotides are capable of producing a twelve carbon fatty acid or fatty acid derived product. In some embodiments, the enoyl-CoA reductase is ter, and wherein the proteins encoded by the polynucleotides are capable of producing a twelve carbon fatty acid or fatty acid derived product. In some embodiments, the thioesterase is selected from the group consisting of AtTE, CpTE (or CperfTE), fadM, LpTE, PA2801TE, tesA, tesB, ybfF, ybgC, and yciA, and wherein the proteins encoded by the polynucleotides are capable of producing a twelve carbon fatty acid or fatty acid derived product. In some embodiments, the thioesterase is selected from the group consisting of fadM, PA2801TE, tesA, tesB, and yciA, and wherein the proteins encoded by the polynucleotides are capable of producing a twelve carbon fatty acid or fatty acid derived product. In some embodiments, one or more 3-ketoacyl-CoA synthases are selected from the group consisting of NphT7, NphT7 I147T, NphT7 F217V, NphT7 I147T and F217V, Npth7 I147S, Npth7 I147S and F217V, synthase III, synthase IV, synthase V, and synthase VI; the keto-CoA reductase is selected from the group consisting of fadB, and fadJ; the 3-hydroxy-acyl-CoA dehydratase is selected form the group consisting of fadB, and fadJ; the enoyl-CoA reductase is selected from the group consisting of ter, ydiO and fadE; and the thioesterase is selected from the group consisting of AtTE, CpTE (or CperfTE), fadM, LpTE, PA2801TE, tesA, tesB, ybfF, ybgC, and yciA, and wherein the proteins encoded by the polynucleotides are capable of producing a fatty acid with a carbon chain length of at least fourteen carbons. In some embodiments, the thioesterase is selected from the group consisting of fadM, tesA, tesB, and yciA, and the proteins encoded by the polynucleotides are capable of producing a fourteen carbon fatty acid or fatty acid derived product. In some embodiments, the thioesterase is selected from the group consisting of AtTE, CpTE (or CperfTE), fadM, Pa2801TE, tesA, tesB, ybfF, ybgC, and yciA, and the proteins encoded by the polynucleotides are capable of producing a sixteen carbon fatty acid or fatty acid derived product. In some embodiments, the thioesterase is selected from the group consisting of AtTE, fadM, tesA, tesB, ybfF, ybgC, and yciA, and the proteins encoded by the polynucleotides are capable of producing a sixteen carbon fatty acid or fatty acid derived product. In some embodiments, one or more 3-ketoacyl-CoA synthases are selected from the group consisting of NphT7, NphT7 I147T, NphT7 F217V, NphT7 I147T and F217V, Npth7 I147S, Npth7 I147S and F217V, synthase III, synthase IV, synthase V, and synthase VI, and wherein the proteins encoded by the polynucleotides are capable of producing a fatty acid with a carbon chain length of greater than or equal to fourteen carbons. In some embodiments, the keto-CoA reductase is selected form the group consisting of fadB, and fadJ, and wherein the proteins encoded by the polynucleotides are capable of producing a fatty acid with a carbon chain length of greater than or equal to fourteen carbons. In some embodiments, the 3-hydroxy-acyl-CoA dehydratase is selected form the group consisting of fadB, and fadJ, and wherein the proteins encoded by the polynucleotides are capable of producing a fatty acid with a carbon chain length of greater than or equal to fourteen carbons. In some embodiments, the enoyl-CoA reductase is selected form the group consisting of ter, ydiO and fadE, and wherein the proteins encoded by the polynucleotides are capable of producing a fatty acid with a carbon chain length of greater than or equal to fourteen carbons. In some embodiments, the thioesterase is selected form the group consisting of AtTE, CpTE (or CperfTE), fadM, LpTE, PA2801TE, tesA, tesB, ybfF, ybgC, and yciA, and wherein the proteins encoded by the polynucleotides are capable of producing a fatty acid with a carbon chain length of greater than or equal to fourteen carbons.

In one aspect the disclosure provides for one or more isolated and purified polynucleotides comprising exogenous nucleic acid molecules encoding proteins comprising a 3-oxoacyl-(acyl carrier protein) synthase III from a species selected from the group consisting of *Alishewanella aestuarii* B11, *Arcobacter butzleri* ED-1, *Clostridiales bacterium* 1_7_47_FAA, *Gluconacetobacter oboediens* 174Bp2, *Gordonia aichiensis* NBRC 108223, *Mesorhizobium* sp. STM 4661, *Pelosinus fermentans* DSM 17108, *Phaeobacter gallaeciensis* 2.10, *Ralstonia solanacearum* Po82, *Saccharomonospora azurea* NA-128, *Saccharomonospora glauca* K62, and *Verrucosispora maxis* AB-18-032, wherein the proteins encoded by the polynucleotides are capable of producing a fatty acid. In some embodiments, the 3-oxoacyl-(acyl carrier protein) synthase III is from a species selected from the group consisting of *Pelosinus fermentans* DSM 17108, *Saccharomonospora glauca* K62, *Verrucosispora maxis* AB-18-032, and *Clostridiales bacterium* 1_7_47_FAA, and wherein the proteins encoded by the polynucleotides are capable of producing an acetyl-CoA. In some embodiments, the 3-oxoacyl-(acyl carrier protein) synthase III is from a species selected from the group consisting of *Saccharomonospora glauca* K62, *Saccharomonospora azurea* NA-128, *Mesorhizobium* sp. STM 4661, and *Clostridiales bacterium* 1_7_47_FAA, and wherein the proteins encoded by the polynucleotides are capable of producing a four carbon fatty acid or fatty acid derived product. In some embodiments, the 3-oxoacyl-(acyl carrier protein) synthase III is from a species selected from the group consisting of *Gordonia aichiensis* NBRC 108223, *Arcobacter butzleri* ED-1, *Clostridiales bacterium* 1_7_47_FAA, *Saccharomonospora glauca* K62, and *Ralstonia solanacearum* Po82, and wherein the proteins encoded by the polynucleotides are capable of producing a six carbon fatty acid or fatty acid derived product. In some embodiments, the 3-oxoacyl-(acyl carrier protein) synthase III is from a species selected from the group consisting of *Gordonia aichiensis* NBRC 108223, *Gluconacetobacter oboediens* 174Bp2, *Arcobacter butzleri* ED-1, *Ralstonia solanacearum* Po82, and *Phaeobacter gallaeciensis* 2.10, and wherein the proteins encoded by the polynucleotides are capable of producing an eight carbon fatty acid or fatty acid derived product. In some embodiments, the 3-oxoacyl-(acyl carrier protein) synthase III is from *Alishewanella aestuarii* B11, and wherein the proteins encoded by the polynucleotides are capable of producing a ten carbon fatty acid or fatty acid derived product. In some embodiments, the proteins encoded by the polynucleotides further comprise a 3-ketoacyl-CoA synthase from *Streptomyces* sp. (strain CL190).

INCORPORATION BY REFERENCE

All publications, patents, and patent applications herein are incorporated by reference to the same extent as if each

BRIEF DESCRIPTION OF THE DRAWINGS

FIG. 27 shows the novel CoA dependent fatty acid pathway and the key enzymes associated therewith.

DESCRIPTION OF EMBODIMENTS

Figure 1:
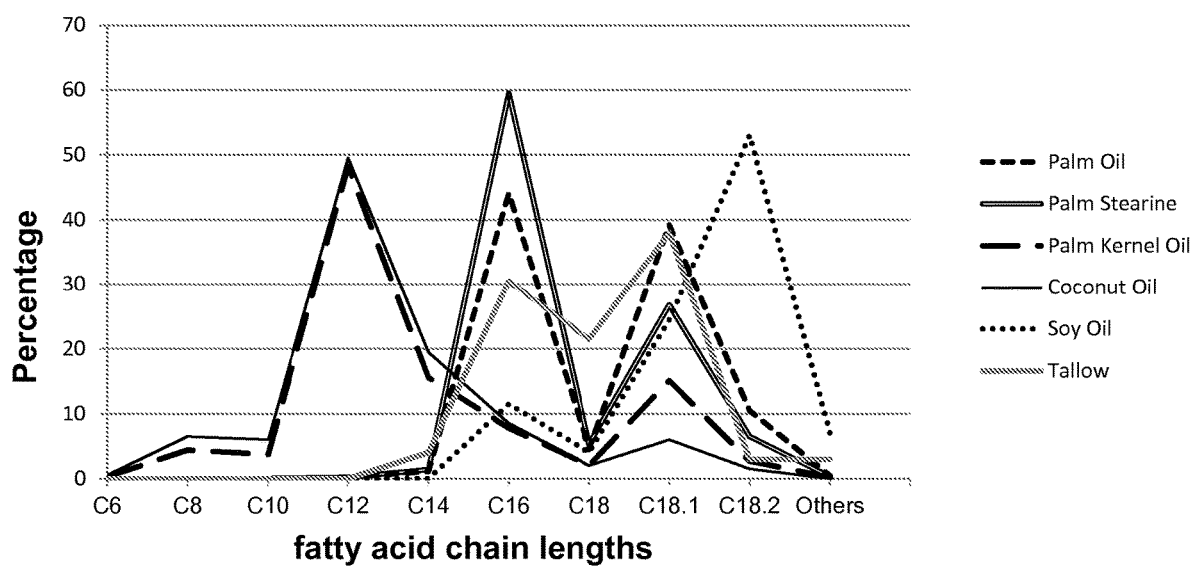
FIG. 1 is a chart showing the carbon chain length distribution in oleochemical feedstocks used to make fatty acids and fatty acid derivatives.
Figure 2:
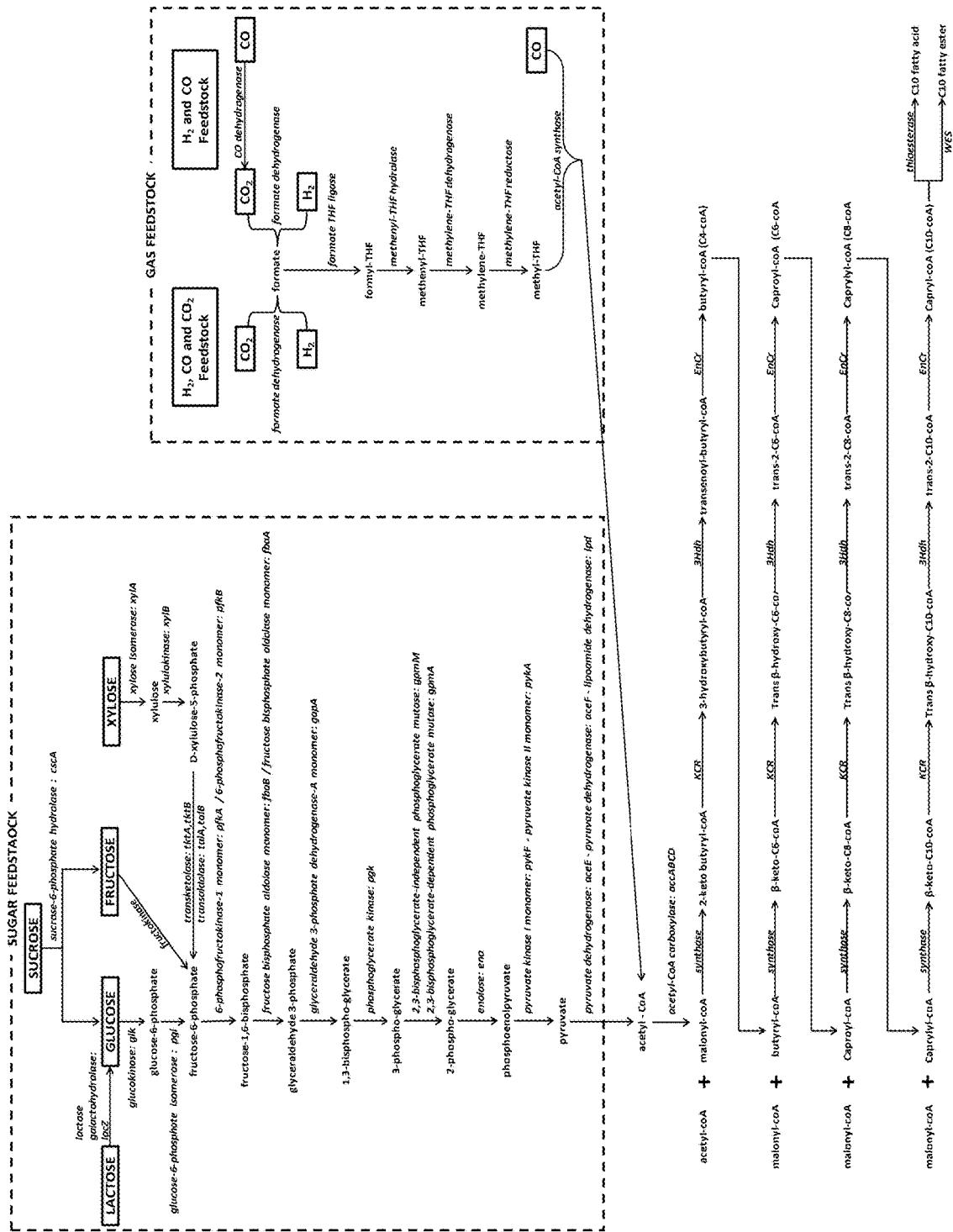
FIG. 2 is a diagram that illustrates various complete bioproduction pathways of the present invention, and provides a representative example of the conversion of various carbon sources to a C10 fatty acid or C10 fatty ester.

The details of one or more inventive embodiments are set forth in the accompanying drawings, the claims, and the description herein. Other features, objects, and advantages of the inventive embodiments disclosed and contemplated herein can be combined with any other embodiment unless explicitly excluded.

The present invention relates generally to various production methods and/or genetically modified microorganisms that have utility for fermentative production of various chemical products, to methods of making such chemical products that utilize populations of these microorganisms in vessels, and to systems for chemical production that employ these microorganisms and methods. Among the benefits of the present invention is increased specific productivity when such microorganisms produce a chemical product during a fermentation event or cycle.

The present invention provides production techniques and/or genetically modified microorganisms to produce a chemical product of interest, such as a fatty acid or fatty acid derived product. The invention provides for one or more means for modulating conversion of malonyl-CoA to fatty acyl molecules, wherein the production pathway comprises a malonyl-CoA dependent pathway that includes an enzymatic conversion step that uses malonyl-CoA as a substrate. In accordance with certain embodiments, the malonyl-CoA dependent pathway is also a malonyl-ACP independent pathway, and is used in combination with the inhibition of a microorganism's native malonyl-ACP dependent fatty acid synthase pathway. In accordance with certain other embodiments of the present invention, fatty acid or fatty acid derived products are produced in a manner dependent on both a malonyl-CoA dependent pathway and a malonyl-ACP dependent pathway.

The genetically modified microorganisms of the invention are metabolically engineered to increase utilization of malonyl-CoA for production of a fatty acid or fatty acid derived product, through a metabolic pathway that is at least in part malonyl-CoA dependent. The fatty acid derived products may include esters, aldehydes, alcohols, alkanes, alkenes, and diacids, with various degrees of desaturation and chain branching, and further downstream products made from such chemical products. Also, genetic modifications may be made to provide one or more chemical products.

The present invention also relates to genetically engineered microorganisms having encoded therein unique enzymes and combinations of enzymes that function within the malonyl-CoA dependent pathway to produce fatty acids or fatty acid derived products of specific chain lengths. The microorganisms and methods provide a cost-competitive means of producing relatively high concentrations of fatty acids or fatty acid derived products of specific chain lengths or products having a relatively narrow carbon chain length distribution (i.e., 2, 3, 4 or less than 5 different carbon chain lengths with in the fatty acid product, e.g. C8/C10 or C8/C10/C12).

I. Definitions/Nomenclature

As used herein unless otherwise indicated, open terms such as "contain," "containing," "include," "including," and the like mean comprising.

Some embodiments herein contemplate numerical ranges. When a numerical range is provided, the range includes the range endpoints. Numerical ranges include all values and subranges therein as if explicitly written out.

As used herein, the article "a" means one or more unless explicitly stated otherwise.

As used herein, herein unless otherwise indicated, the one letter abbreviations A, R, N, C, D, Q, E, G, H, I, L, K, M, F, P, S, T, W, Y and V, represent the twenty amino acids commonly found in peptides synthesized in nature.

As used herein, unless otherwise indicated, the convention Letter1NumberLetter2, when applied to polypeptides, means that the amino acid having the one letter code Letter 1, at Number position in the polypeptide, is substituted with the amino acid having the one letter code Letter2. For example, I147T means that the amino acid I, found at position 147 in the peptide, is substituted with the amino acid T.

As used herein, unless otherwise indicated, the symbol CNumber means a carbon backbone chain length having the indicated number of carbon atoms. For example, C20 means a chemical backbone having a 20 carbon chain length. Note that the number of carbons included in the carbon backbone does not include carbon contained in functional units attached to the backbone (e.g., a functional unit in a fatty acid derived product).

As used herein, "reduced enzymatic activity," "reducing enzymatic activity," "decreased enzymatic activity," "decreasing enzymatic activity," and the like is meant to indicate that a microorganism cell's, or an isolated enzyme, exhibits a lower level of activity than that measured in a comparable cell of the same species or its native enzyme. That is, enzymatic conversion of the indicated substrate(s) to indicated product(s) under known standard conditions for that enzyme is at least 10, at least 20, at least 30, at least 40, at least 50, at least 60, at least 70, at least 80, or at least 90 percent less than the enzymatic activity for the same biochemical conversion by a native (non-modified) enzyme under a standard specified condition. These terms also can include elimination of that enzymatic activity. A decrease in enzymatic activity may be achieved in variety a ways known to those skilled in the art, including for example, a gene disruption or a gene deletion. A decrease in enzymatic activity may be temporal, be controlled through the expression of various genetic elements, or decrease in response to the cultivation conditions of the cell. A cell having reduced enzymatic activity of an enzyme can be identified using any method known in the art. For example, enzyme activity assays can be used to identify cells having reduced enzyme activity. See, for example, Enzyme Nomenclature, Academic Press, Inc., New York 2007.

As used herein, "increase enzymatic activity," "increasing enzymatic activity," and the like is meant to indicate that a microorganism cell's, or an isolated enzyme, exhibits a higher level of activity than that measured in a comparable cell of the same species or its native enzyme. That is, enzymatic conversion of the indicated substrate(s) to indicated product(s) under known standard conditions for that enzyme is at least 10, at least 20, at least 30, at least 40, at least 50, at least 60, at least 70, at least 80, or at least 90 percent greater than the enzymatic activity for the same biochemical conversion by a native (non-modified) enzyme under a standard specified condition. These terms also can include addition of an exogenous enzymatic activity. An increase in enzymatic activity may be temporal, be controlled through the expression of various genetic elements, or increase in response to the cultivation conditions of the cell. A cell having increased enzymatic activity of an enzyme can be identified using any method known in the art, including the enzyme activity assays noted above used to identify cells having reduced enzyme activity.

As used herein, the term "gene disruption," or grammatical equivalents thereof (and including "to disrupt enzymatic function," "disruption of enzymatic function," and the like), is intended to mean a genetic modification to a microorganism that renders the encoded gene product as having a reduced polypeptide activity compared with polypeptide activity in or from a microorganism cell not so modified. The genetic modification can be, for example, deletion of the entire gene, deletion or other modification of a regulatory sequence required for transcription or translation, deletion of a portion of the gene which results in a truncated gene product (e.g., enzyme) or by any of various mutation strategies that reduces activity (including to no detectable activity level) of the encoded gene product. A disruption may broadly include a deletion of all or part of the nucleic acid sequence encoding the enzyme, and also includes, but is not limited to other types of genetic modifications, e.g., introduction of stop codons, frame shift mutations, introduction or removal of portions of the gene, and introduction of a degradation signal, those genetic modifications affecting mRNA transcription levels and/or stability, and altering the promoter or repressor upstream of the gene encoding the enzyme.

In various contexts, a gene disruption is taken to mean any genetic modification to the DNA, mRNA encoded from the DNA, and the corresponding amino acid sequence that results in reduced polypeptide activity. Many different methods can be used to make a cell having reduced polypeptide activity. For example, a cell can be engineered to have a disrupted regulatory sequence or polypeptide-encoding sequence using common mutagenesis or knock-out technology. See, e.g., *Methods in Yeast Genetics* (1997 edition), Adams et al., Cold Spring Harbor Press (1998). One particularly useful method of gene disruption is complete gene deletion because it reduces or eliminates the occurrence of genetic reversions in the genetically modified microorganisms of the invention. Accordingly, a disruption of a gene whose product is an enzyme thereby disrupts enzymatic function. Alternatively, antisense technology can be used to reduce the activity of a particular polypeptide. For example, a cell can be engineered to contain a cDNA that encodes an antisense molecule that prevents a polypeptide from being translated. Further, gene silencing can be used to reduce the activity of a particular polypeptide.

The term "heterologous" is intended to include the term "exogenous" as the latter term is generally used in the art. Heterologous can refer to polypeptides and/or nucleic acids which are not ordinarily produced by the host cell. Such heterologous polypeptides and/or nucleic acid thus may comprise polypeptides which either do not have substantial amino acid sequence homology with those proteins produced by the host cell or may comprise polypeptides with substantial but incomplete homology to proteins produced by the host cell or the cell line from which the host cell is derived.

The term "heterologous DNA," "heterologous nucleic acid sequence," and the like as used herein refers to a nucleic acid sequence wherein at least one of the following is true: (a) the sequence of nucleic acids is foreign to (i.e., not naturally found in) a given host microorganism; (b) the sequence may be naturally found in a given host microorganism, but in an unnatural amount (e.g., greater than expected) or position; or (c) the sequence of nucleic acids comprises two or more subsequences that are not found in the same relationship to each other in nature. For example, regarding instance (c), a heterologous nucleic acid sequence that is recombinantly produced will have two or more sequences from unrelated genes arranged to make a new functional nucleic acid.

The term "antisense molecule" as used herein encompasses any nucleic acid molecule or nucleic acid analog (e.g., peptide nucleic acids) that contains a sequence that corresponds to the coding strand of an endogenous polypeptide. An antisense molecule also can have flanking sequences (e.g., regulatory sequences). Thus, antisense molecules can be ribozymes or antisense oligonucleotides.

As used herein, a ribozyme can have any general structure including, without limitation, hairpin, hammerhead, or axhead structures, provided the molecule cleaves RNA.

Bio-production, as used herein, may be aerobic, microaerobic, or anaerobic.

As used herein, the language "sufficiently homologous" refers to proteins or portions thereof that have amino acid sequences that include a minimum number of identical or equivalent amino acid residues when compared to an amino acid sequence of the amino acid sequences provided in this application (including the SEQ ID Nos./sequence listings) such that the protein or portion thereof is able to achieve the respective enzymatic reaction and/or other function. To determine whether a particular protein or portion thereof is sufficiently homologous may be determined by an assay of enzymatic activity, such as those commonly known in the art.

Descriptions and methods for sequence identity and homology are intended to be exemplary and it is recognized that these concepts are well-understood in the art. Further, it is appreciated that nucleic acid sequences may be varied and still encode an enzyme or other polypeptide exhibiting a desired functionality, and such variations are within the scope of the present invention.

Further to nucleic acid sequences, "hybridization" refers to the process in which two single-stranded polynucleotides bind non-covalently to form a stable double-stranded polynucleotide. The term "hybridization" may also refer to triple-stranded hybridization. The resulting (usually) double-stranded polynucleotide is a "hybrid" or "duplex." "Hybridization conditions" will typically include salt concentrations of less than about 1M, more usually less than about 500 mM and less than about 200 mM. Hybridization temperatures can be as low as 5° C., but are typically greater than 22° C., more typically greater than about 30° C., and often are in excess of about 37° C. Hybridizations are usually performed under stringent conditions, i.e. conditions under which a probe will hybridize to its target subsequence.

Stringent conditions are sequence-dependent and are different in different circumstances. Longer fragments may require higher hybridization temperatures for specific hybridization. As other factors may affect the stringency of hybridization, including base composition and length of the complementary strands, presence of organic solvents and extent of base mismatching, the combination of parameters is more important than the absolute measure of any one alone. Generally, stringent conditions are selected to be about 5° C. lower than the $T_m$ (temperature at which half the DNA is present in a single-stranded (denatured) form) for the specific sequence at a defined ionic strength and pH. Exemplary stringent conditions include salt concentration of at least 0.01 M to no more than 1 M Na ion concentration (or other salts) at a pH 7.0 to 8.3 and a temperature of at least 25° C. For example, conditions of 5×SSPE (750 mM NaCl, 50 mM Na Phosphate, 5 mM EDTA, pH 7.4) and a temperature of 25-30° C. are suitable for allele-specific probe hybridizations. For stringent conditions, see for example, Sambrook and Russell and Anderson "Nucleic Acid Hybridization" 1$^{st}$ Ed., BIOS Scientific Publishers Limited (1999), which is hereby incorporated by reference for hybridization protocols. "Hybridizing specifically to" or "specifically hybridizing to" or like expressions refer to the binding, duplexing, or hybridizing of a molecule substantially to or only to a particular nucleotide sequence or sequences under stringent conditions when that sequence is present in a complex mixture (e.g., total cellular) DNA or RNA.

The use of the phrase "segment of interest" is meant to include both a gene and any other nucleic acid sequence segment of interest. One example of a method used to obtain a segment of interest is to acquire a culture of a microorganism, where that microorganism's genome includes the gene or nucleic acid sequence segment of interest.

When the genetic modification of a gene product, i.e., an enzyme, is referred to herein, including the claims, it is understood that the genetic modification is of a nucleic acid sequence, such as or including the gene, that normally encodes the stated gene product, i.e., the enzyme.

In some embodiments a truncated respective polypeptide has at least about 90%, or at least about 91%, or at least about 92%, or at least about 93%, or at least about 94%, or at least about 95%, or at least about 96%, or at least about 97%, or at least about 98%, or at least about 99% of the full length of a polypeptide encoded by a nucleic acid sequence encoding the respective native enzyme, and more particularly at least 95% of the full length of a polypeptide encoded by a nucleic acid sequence encoding the respective native enzyme. By a polypeptide having an amino acid sequence at least, for example, 95% "identical" to a reference amino acid sequence of a polypeptide is intended that the amino acid sequence of the claimed polypeptide is identical to the reference sequence except that the claimed polypeptide sequence can include up to five amino acid alterations per each 100 amino acids of the reference amino acid of the polypeptide. In other words, to obtain a polypeptide having an amino acid sequence at least 95% identical to a reference amino acid sequence, up to 5% of the amino acid residues in the reference sequence can be deleted or substituted with another amino acid, or a number of amino acids up to 5% of the total amino acid residues in the reference sequence can be inserted into the reference sequence. These alterations of the reference sequence can occur at the amino or carboxy terminal positions of the reference amino acid sequence or anywhere between those terminal positions, interspersed either individually among residues in the reference sequence or in one or more contiguous groups within the reference sequence. In other embodiments truncation may be more substantial, as described elsewhere herein.

Species and other phylogenic identifications are according to the classification known to a person skilled in the art of microbiology.

Where methods and steps described herein indicate certain events occurring in certain order, those of ordinary skill in the art will recognize that the ordering of certain steps may be modified and that such modifications are in accordance with the variations of the invention. Additionally, certain steps may be performed concurrently in a parallel process when possible, as well as performed sequentially.

The meaning of abbreviations is as follows: "C" means Celsius or degrees Celsius, as is clear from its usage, DCW means dry cell weight, "s" means second(s), "min" means minute(s), "h," "hr," or "hrs" means hour(s), "psi" means pounds per square inch, "nm" means nanometers, "d" means day(s), "µL" or "uL" or "ul" means microliter(s), "mL" means milliliter(s), "L" means liter(s), "mm" means millimeter(s), "nm" means nanometers, "mM" means millimolar, "µM" or "uM" means micromolar, "M" means molar, "mmol" means millimole(s), "µmol" or "uMol" means micromole(s)", "g" means gram(s), "µg" or "ug" means microgram(s) and "ng" means nanogram(s), "PCR" means polymerase chain reaction, "OD" means optical density, "OD$_{600}$" means the optical density measured at a photon wavelength of 600 nm, "kDa" means kilodaltons, "g" means the gravitation constant, "bp" means base pair(s), "kbp" means kilobase pair(s), "% w/v" means weight/volume percent, "% v/v" means volume/volume percent, "IPTG" means isopropyl-µ-D-thiogalactopyranoiside, "RBS" means ribosome binding site, "rpm" means revolutions per minute, "HPLC" means high performance liquid chromatography, "UPLC" means ultra performance liquid chromatography, and "GC" means gas chromatography.

By "means for modulating" is meant any one of the following: 1) providing in a microorganism cell at least one polynucleotide that encodes at least one polypeptide having certain enzymatic activity, wherein such enzymatic activity of the polypeptide so encoded is either: (a) exogenous, (b) native but is lower or higher than the enzymatic activity of its native form (such as by mutation and/or promoter substitution, etc.), or (c) modulated to have a reduced or increased enzymatic activity at any point during a fermentation process (such as by temperature sensitivity, inducible promoter, etc.); or 2) providing to a vessel comprising a microorganism cell or population an inhibitor that inhibits enzymatic activity or a supplement that increases enzymatic activity. These means may be provided in combination with one another.

As used herein, references to "synthase III", "synthase IV", "synthase V", and "synthase VI" (except in the context of the name of a specific enzyme sequence included in a FASTA header in one of the Tables) shall refer to the third, fourth, fifth and sixth synthase, respectively, that is included in among a group of synthases. Synthase III, synthase IV, synthase V, and synthase VI may be any 3-ketoacyl-CoA synthase disclosed herein. For example, a reference herein to a genetically modified organism comprising a heterologous nucleic acid sequence encoding a 3-ketoacyl-CoA synthase selected from the group consisting of synthase III and synthase IV means either: (1) a genetically modified organism comprising a heterologous nucleic acid sequence encoding at least three 3-ketoacyl-CoA synthases wherein at least one of such 3-ketoacyl-CoA synthases is a 3-ketoacyl-CoA synthase disclosed herein; or (2) a genetically modified organism comprising a heterologous nucleic acid sequence encoding at least four 3-ketoacyl-CoA synthases wherein at least one of such 3-ketoacyl-CoA synthases is a 3-ketoacyl-CoA synthase disclosed herein.

II. The Bioproduction Pathways of the Present Invention

A. CoA Dependent Pathways

Figure 26:
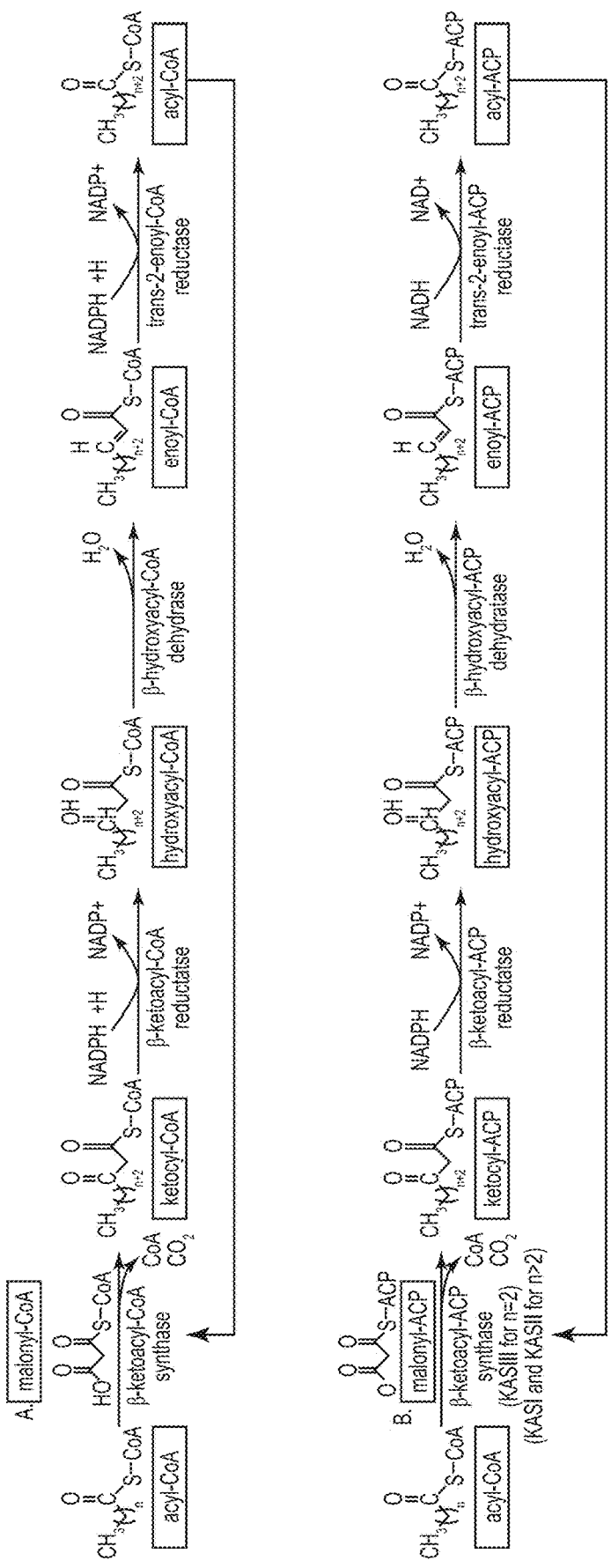
FIG. 26 shows a fatty acid pathway that comprises four steps which utilizes a pathway that is similar to the type II fatty acid synthesis (FAS) system utilized by bacteria. Both fatty acid syntheses are shown in FIG. 26. A. In step 1, 3-ketoacyl-CoA synthase catalyzes the condensation of acyl-CoA (or acetyl-CoA at initial step of chain elongation) with malonyl-CoA to yield β-ketoacyl-CoA. In the subsequent steps, β-ketoacyl-CoA undergoes reduction by β-ketoacyl-CoA reductase (step 2), dehydration by β-hydroxyacyl-CoA dehydratase (step 3), and a final reduction by enoyl-CoA reductase (step 4). Reactions are repeated and each cycle adds two carbons to the acyl-CoA chain. (B) Type II FAS System. Fatty acid synthesis is initiated by (3-ketoacyl-ACP synthase (KASIII) (step 1a) which catalyzes the condensation of acetyl-CoA with malonyl-ACP to yield β-ketoacyl-ACP. In the subsequent steps, β-ketoacyl-ACP undergoes reduction (step 2), dehydration (step 3), and reduction (step 4) similar to CoA specific pathway. Further elongation steps are initiated by KASI or KASII (step 1b) which catalyzes the condensation of acyl-ACP with malonyl-ACP.

The present invention relates to a fatty acid pathway that comprises four steps which utilizes a pathway that is similar to the type II fatty acid synthesis (FAS) system utilized by bacteria. Both fatty acid syntheses are shown below in Scheme 1. As illustrated in FIG. 26 in Scheme 1, both pathways are cyclical processes that involve: 1) condensation of acyl chain, 2) reduction of the condensation product, 3) dehydration, and 4) reduction to produce an acyl chain that is two carbon atoms longer and the process is repeated with each cycle adding two additional carbons. Given the similarities between the two processes, most enzymes utilized for the type II FAS system can also function in the propose fatty acid pathway. However, a key step involving the chain elongation of acyl moiety is quite different. In accordance with the present invention, a condensation step of the proposed fatty acid pathway employs, inter alia, a ketoacyl-CoA synthase that catalyzes the condensation of acyl-CoA with malonyl-CoA, while type II FAS system utilizes ketoacyl-ACP synthases that catalyzes the condensation of acyl-ACP with malonyl-ACP. This type of CoA dependent pathway has been previously known for elongation of longer fatty acid chain lengths (e.g., elongation to C14 to C16 or higher). In accordance with the present invention, however, applicants have discovered novel genetically modified microorganisms capable of producing fatty acids through the elongation pathway illustrated in Scheme 1A and which is capable of elongation of lower carbon chain lengths through this pathway (e.g., elongation of C4 to C6, C6 to C8, C8 to C10, C10 to C12, and C12 to C14). (Note that β-Ketoacyl and 3-ketoacyl are synonymous.)

Figure 3:
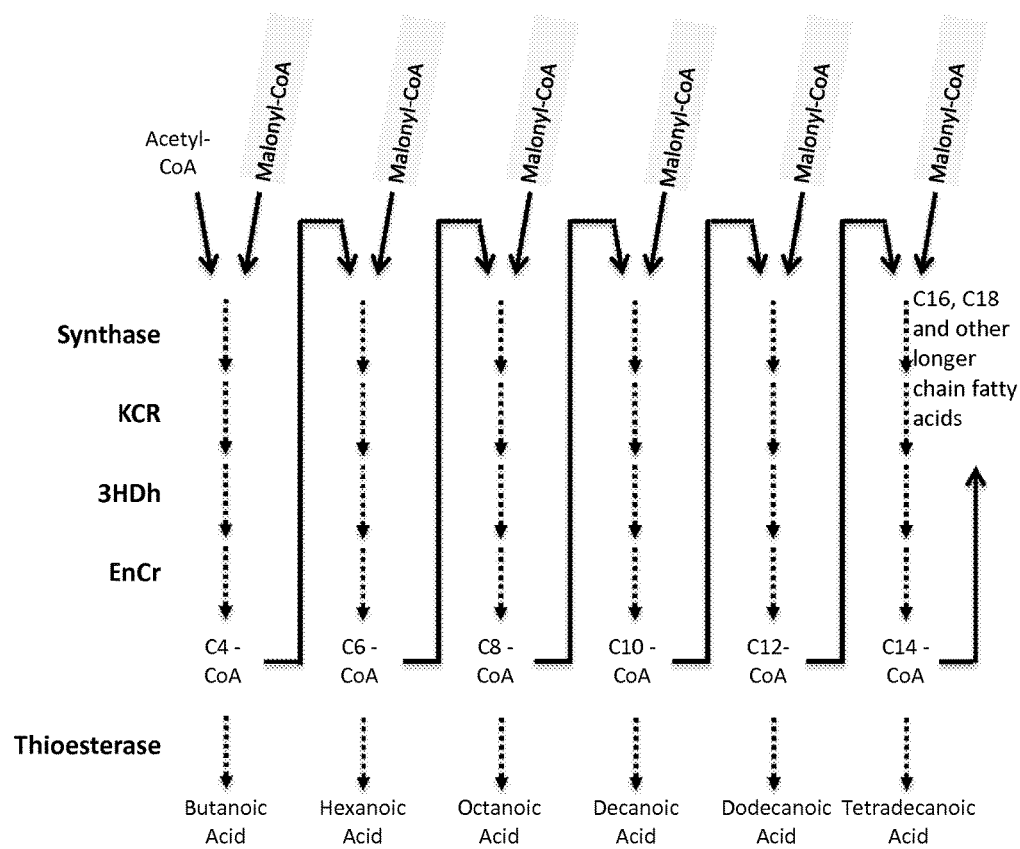
FIG. 3 is a diagram showing production of even chain fatty acids using acetyl-CoA as a primer and malonyl-CoA (MCA) as the extender molecule.
Figure 4:
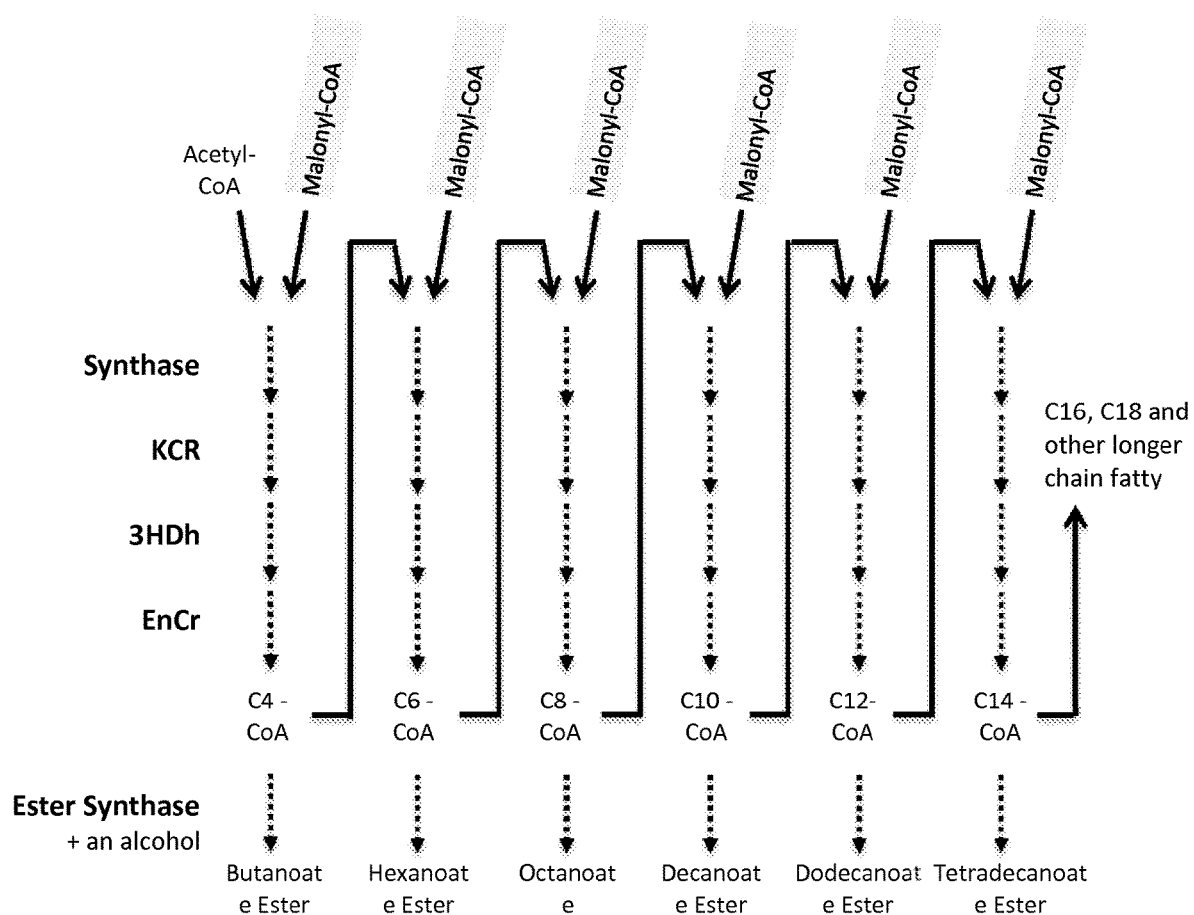
FIG. 4 is a diagram showing production of even chain fatty acid esters using acetyl-CoA as a primer and malonyl-CoA (MCA) as the extender molecule.
Figure 5:
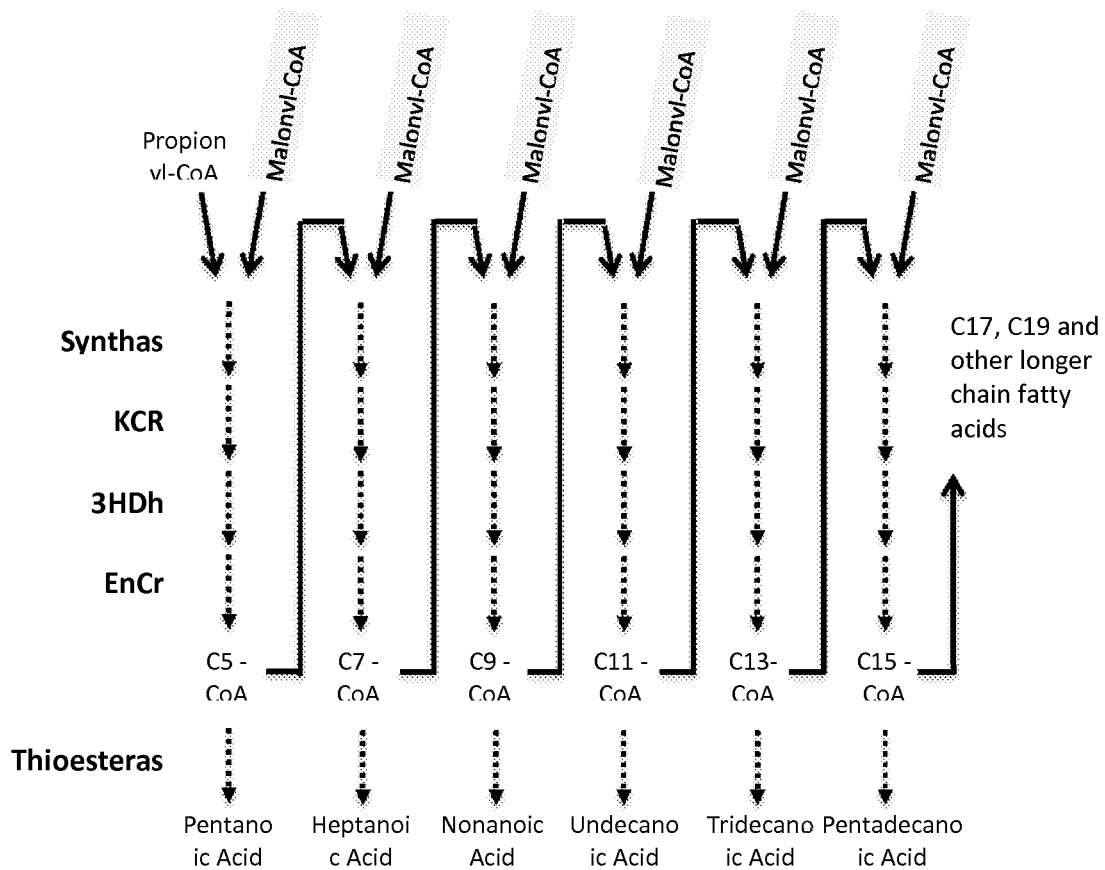
FIG. 5 is a diagram showing production of odd chain fatty acids using propionyl-CoA as a primer and malonyl-CoA (MCA) as the extender molecule.
Figure 6:
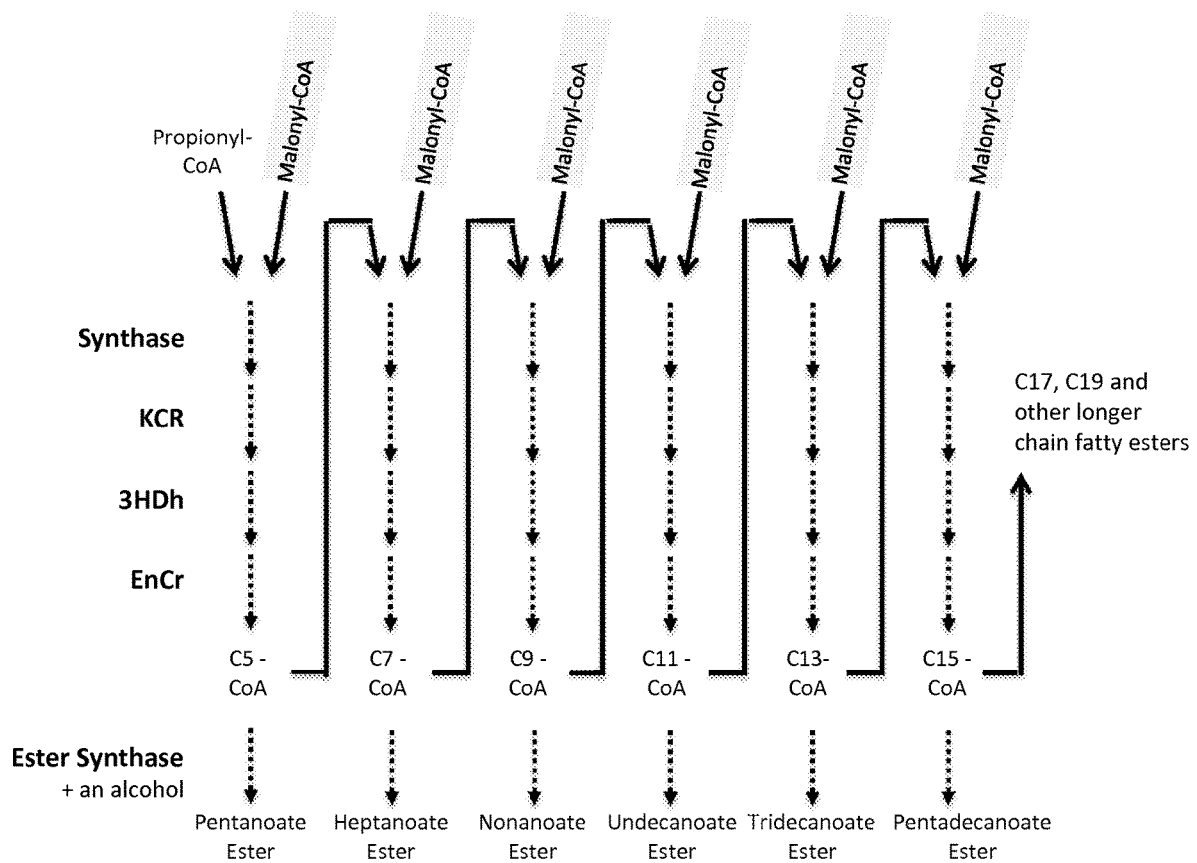
FIG. 6 is a diagram showing production of odd chain fatty acid esters using propionyl-CoA as a primer and malonyl-CoA (MCA) as the extender molecule.
Figure 27:
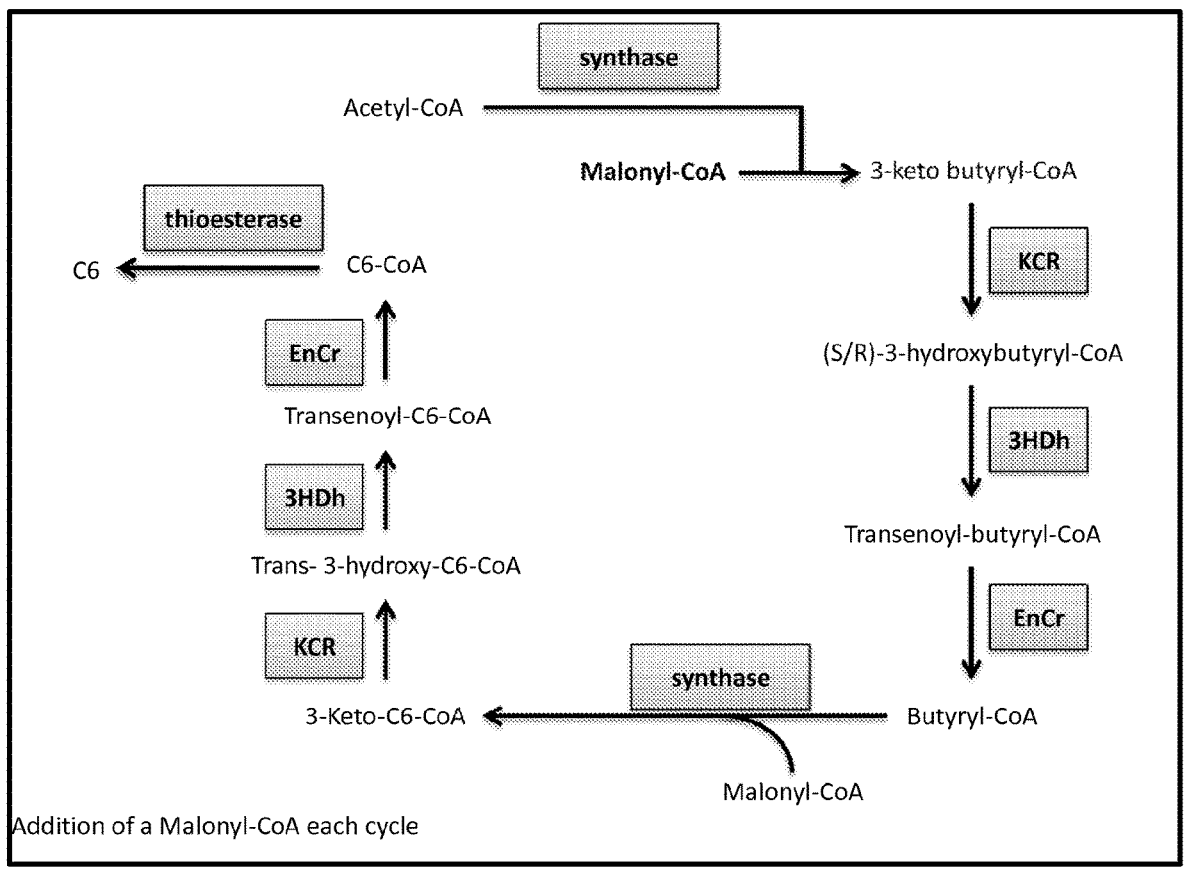
FIG. 27 depicts the novel CoA dependent fatty acid pathway and the key enzymes associated therewith.

The novel CoA dependent fatty acid pathway and the key enzymes associated therewith are illustrated in FIG. 27 for the production of a C6 fatty acid. One skilled in the art will appreciate the cyclic nature of this pathway, wherein a malonyl-CoA is added during each cycle until the desired carbon chain length is reached. The cyclic nature of this novel pathway is further illustrated in FIG. 3 to FIG. 6. FIG. 3 illustrates the production of even chain fatty acids using acetyl-CoA as a primer and malonyl-CoA (MCA) as the extender molecule. FIG. 4 illustrates the production of even chain fatty acid esters using acetyl-CoA as a primer and malonyl-CoA (MCA) as the extender molecule. FIG. 5 illustrates the production of odd chain fatty acids using propionyl-CoA as a primer and malonyl-CoA (MCA) as the extender molecule. FIG. 6 illustrates the production of odd chain fatty acid esters using propionyl-CoA as a primer and malonyl-CoA (MCA) as the extender molecule.

In accordance with the present invention, fatty acid or fatty acid derived products are produced in a manner dependent at least in part on a malonyl-CoA dependent pathway. In accordance with certain embodiments, the malonyl-CoA dependent pathway is also a malonyl-ACP independent fatty acid production pathway, and may be used in combination with the inhibition of a microorganism's malonyl-ACP dependent fatty acid synthase pathway. In accordance with certain other embodiments of the present invention, fatty acid or fatty acid derived products are produced through a microorganism pathway that is partially malonyl-CoA dependent and partially malonyl-ACP dependent. In accordance with certain other embodiments of the present invention, fatty acid or fatty acid derived products are produced through a microorganism pathway that is initiated through the reaction of malonyl-CoA and acetyl-CoA via a CoA dependent pathway.

Referring to FIG. 7 to FIG. 14, examples of various malonyl-CoA dependent pathways are illustrated. The pathways illustrated are examples of the production of fatty acids or esters having carbon chain lengths of 4, 6, 8, or 10. One skilled in the art would appreciate that in view of cyclic nature of the pathways, the pathways could be extended to depict higher carbon chain lengths. In accordance with the present invention, genetically modified microorganisms are provided that include various combinations of enzymes that determine (1) the carbon chain lengths produced by the organism, and (2) the extent to which the pathway is CoA-dependent or both CoA- and ACP-dependent. In addition, if the acetyl-CoA precursor that initiates the pathways shown in FIG. 7 to FIG. 14 is changed to propionyl-CoA, then fatty acids and esters having a carbon chain length that is an odd number (i.e., 5, 7, 9, or 11) will be made through the pathways.

III. Genetic Modifications to Microorganisms

The present invention herein provides genetically modified microorganisms that are modified to enable and/or improve a microorganism's ability to produce fatty acids and/or fatty acid derivatives at least in part through a malonyl-CoA dependent pathway. The malonyl-CoA dependent pathway may be independent of a malonyl-ACP pathway or may be in combination with a malonyl-ACP pathway.

In general, the genetically modified organism herein can be *Clostridium, Zymomonas, Escherichia, Salmonella, Rhodococcus, Pseudomonas, Streptomyces, Bacillus, Lactobacillus, Enterococcus, Alcaligenes, Klebsiella, Paenibacillus, Arthrobacter, Corynebacterium, Brevibacterium, Pichia, Candida, Hansenula, Thraustochytrids, Bacteriophage, Saccharomyces*; can be a prokaryotic cell; can be a eukaryotic cell; and/or can be a bacteria, yeast, fungi, microalgae or algae cell. Preferably the genetically modified organism is *Escherichia coli*.

The genetic modifications contemplated by the present invention include enhancing the organism's function in three phases of a CoA-dependent fatty acid pathway contemplated herein: (1) initiation of the fatty acid pathway; (2) chain length extension (or elongation); and (3) termination of the process once a desired chain length is achieved. These three phases are exemplified in FIG. 7 to FIG. 14.

A. Genetic Modifications to Drive Phase One—Reaction Initiation

Figure 7:
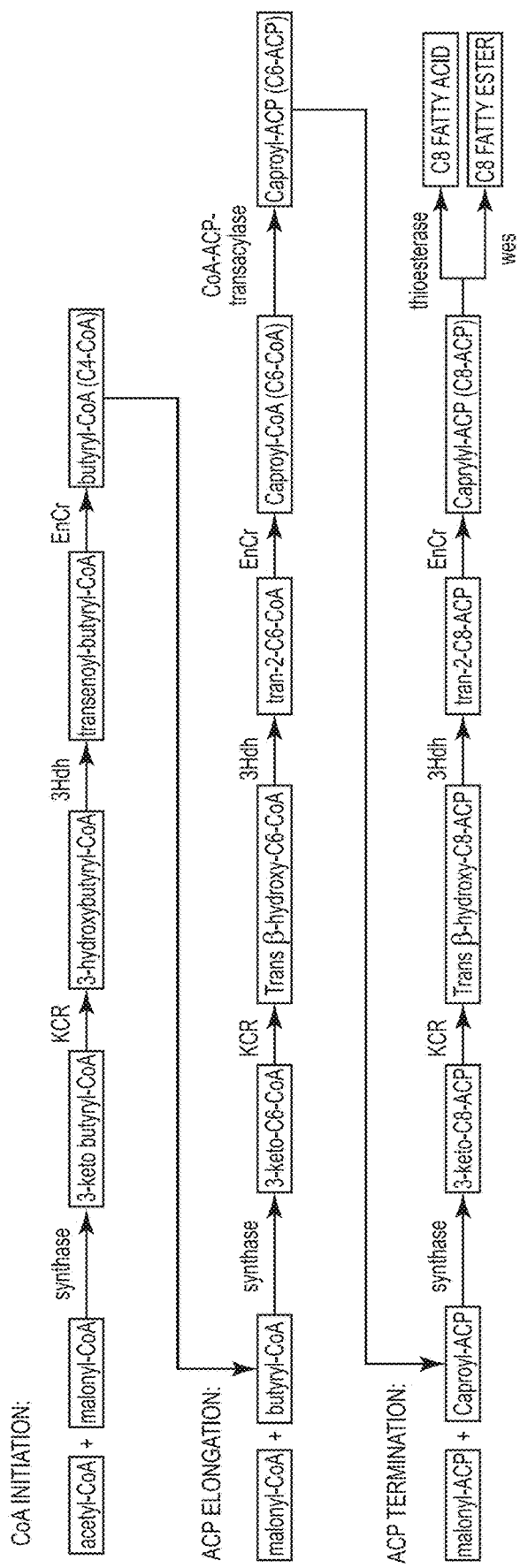
FIG. 7-FIG. 14 are a series of various reaction pathways in accordance with the present invention.
Figure 8:
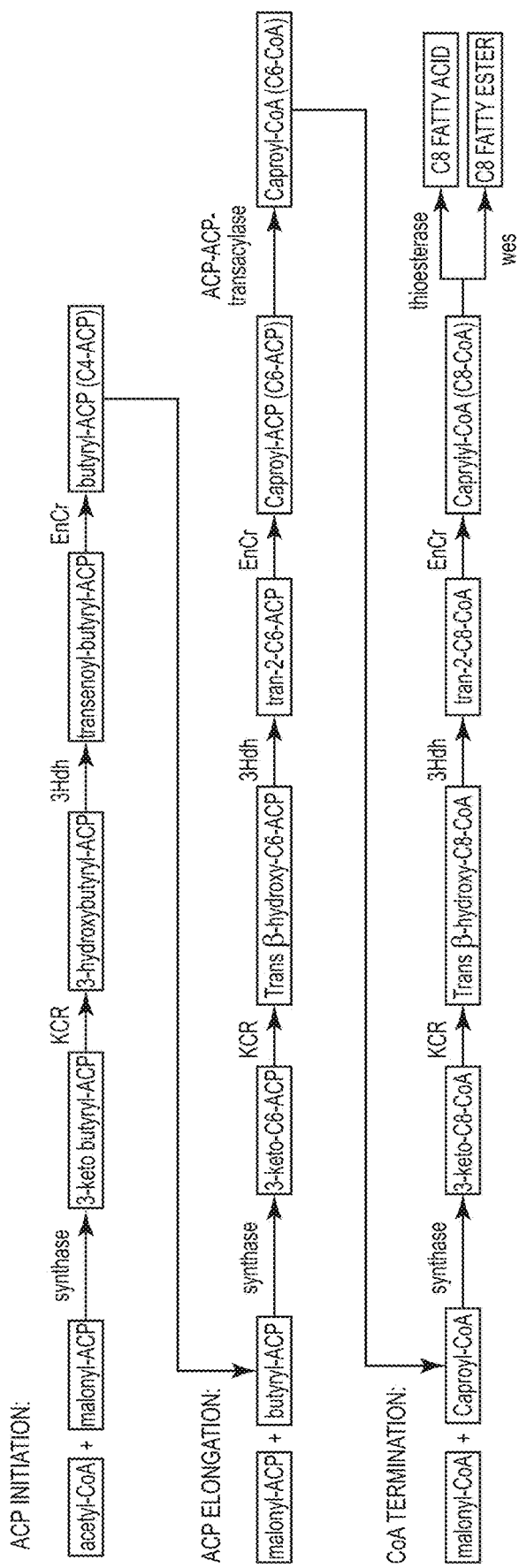
Figure 9:
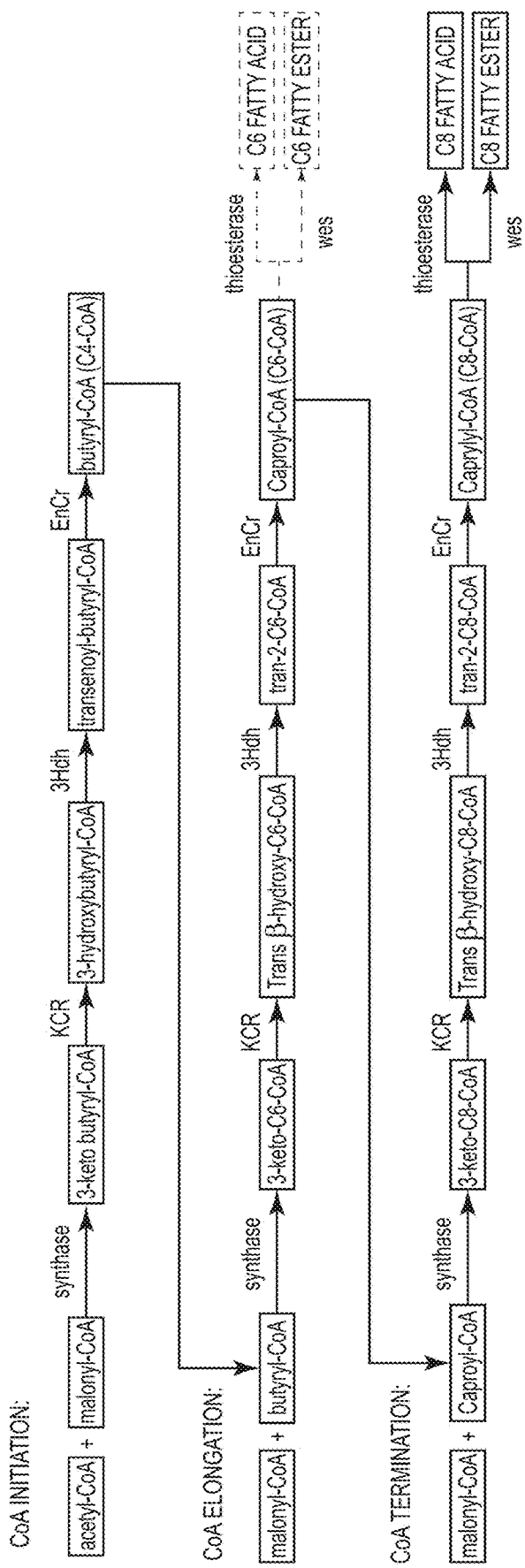
Figure 10:
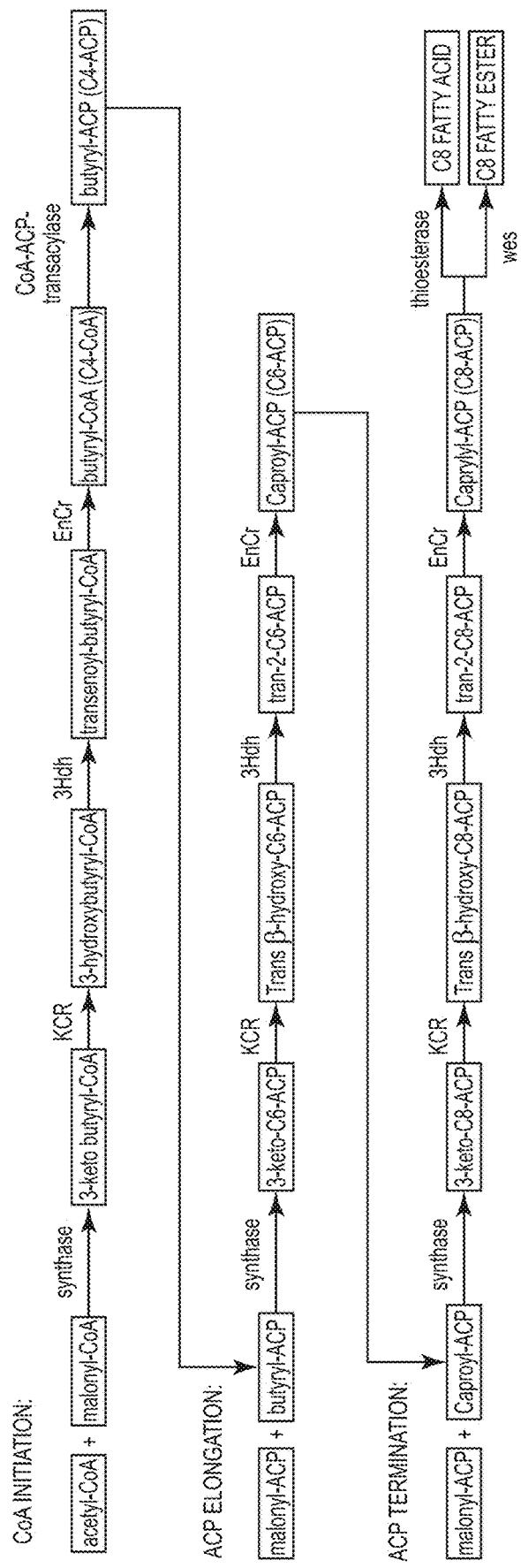
Figure 11:
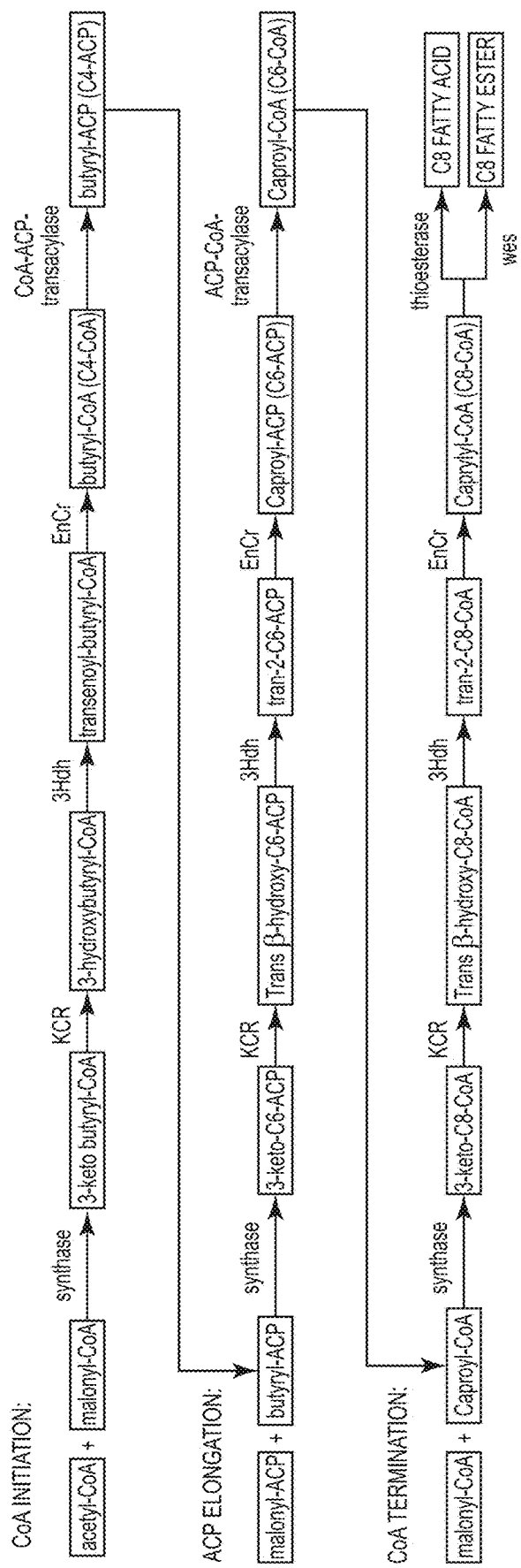

The first phase of the malonyl-CoA dependent pathway is reaction initiation. The reaction to produce even chain fatty acid products is initiated through the conversion of acetyl-CoA+malonyl-CoA to 3-ketobutyryl-CoA. This conversion requires a synthase—a ketobutyryl-CoA synthase. As illustrated in FIG. 7, the reaction initiation phase is completed by the conversion of ketobutyryl-CoA to butyryl-CoA by three enzymes: a ketoacyl-CoA reductase ("KCR"), a hydroxyacyl-CoA dehydratase ("3HDh"), and an enoyl-CoA reductase ("EnCr"). The reaction to produce odd chain fatty acid products is initiated through the conversion of propionyl-CoA+malonyl-CoA to 3-ketovaleryl-CoA with subsequent reduction and dehydration reactions catalyzed by KCR, 3HDh, and EnCr. Accordingly, a genetically modified microorganism of the present invention includes native or exogenous enzymes encoded therein that provide these functions.

(1) Phase One (Reaction Initiation)—Synthases

In accordance with one aspect of the present invention, NphT7, a 3-ketoacyl-CoA synthase from *Streptomyces* sp. Strain CL190 acts as the ketobutyryl-CoA synthase that initiates fatty acid synthesis by catalyzing the condensation of acetyl-CoA with malonyl-CoA to 3-ketobutyryl-CoA and with reduction→dehydration→reduction to butyryl-CoA ($C_4$-CoA). In accordance with one aspect of the present invention, NphT7 acts as the 3-ketovaleryl-CoA synthase that initiates fatty acid synthesis by catalyzing the condensation of propionyl-CoA with malonyl-CoA to 3-ketovaleryl-CoA and with reduction→dehydration→reduction to valeryl-CoA ($C_5$—CoA). The protein sequence for NphT7 (BAJ10048.1 GI:299758082) and its nucleotide sequence (AB540131.1 GI:299758081) are provided below (SEQ ID NO:1; SEQ ID NO:2).

```
                                           SEQ ID NO: 1
MTDVRFRIIGTGAYVPERIVSNDEVGAPAGVDDDWITRKTGIRQRRWAAD

DQATSDLATAAGRAALKAAGITPEQLTVIAVATSTPDRPQPPTAAYVQHH

LGATGTAAFDVNAVCSGTVFALSSVAGTLVYRGGYALVIGADLYSRILNP

ADRKTVVLFGDGAGAMVLGPTSTGTGPIVRRVALHTFGGLTDLIRVPAGG

SRQPLDTDGLDAGLQYFAMDGREVRRFVTEHLPQLIKGFLHEAGVDAADI

SHFVPHQANGVMLDEVFGELHLPRATMHRTVETYGNTGAASIPITMDAAV

RAGSFRPGELVLLAGFGGGMAASFALIEW
```

```
                                              SEQ ID NO: 2
  1  cctgcaggcc gtcgagggcg cctggaagga ctacgcggag caggacggcc ggtcgctgga 61  ggagttcgcg gcgttcgtct accaccagcc gttcacgaag atggcctaca aggcgcaccg 121  ccacctgctg aacttcaacg gctacgacac cgacaaggac gccatcgagg gcgccctcgg 181  ccagacgacg gcgtacaaca acgtcatcgg caacagctac accgcgtcgg tgtacctggg 241  cctgccgcc ctgctcgacc aggcggacga cctgacgggc cgttccatcg gcttcctgag 301  ctacggctcg ggcagcgtcg ccgagttctt ctcgggcacc gtcgtcgccg ggtaccgcga 361  gcgtctgcgc accgaggcga accaggaggc gatcgcccgg cgcaagagcg tcgactacgc 421  cacctaccgc gagctgcacg agtacacgct cccgtccgac ggcggcgacc acgccacccc 481  ggtgcagacc accggcccct tccggctggc cgggatcaac gaccacaagc gcatctacga 541  ggcgcgctag cgacacccct cggcaacggg gtgcgccact gttcggcgca ccccgtgccg
```

```
 601 ggctttcgca cagctattca cgaccatttg aggggcgggc
     agccgcatga ccgacgtccg
 661 attccgcatt atcggtacgg gtgcctacgt accggaacgg
     atcgtctcca acgatgaagt
 721 cggcgcgccg gccggggtgg acgacgactg gatcacccgc
     aagaccggta tccggcagcg
 781 tcgctgggcc gccgacgacc aggccacctc ggacctggcc
     acggccgcgg ggcgggcagc
 841 gctgaaagcg gcgggcatca cgcccgagca gctgaccgtg
     atcgcggtcg ccacctccac
 901 gccggaccgg ccgcagccgc ccacggcggc ctatgtccag
     caccacctcg gtgcgaccgg
 961 cactgcggcg ttcgacgtca acgcggtctg ctccggcacc
     gtgttcgcgc tgtcctcggt
1021 ggcgggcacc ctcgtgtacc ggggcggtta cgcgctggtc
     atcggcgcgg acctgtactc
1081 gcgcatcctc aacccggccg accgcaagac ggtcgtgctg
     ttcggggacg gcgccggcgc
1141 aatggtcctc gggccgacct cgaccggcac gggccccatc
     gtccggcgcg tcgccctgca
1201 caccttcggc ggcctcaccg acctgatccg tgtgcccgcg
     ggcggcagcc gccagccgct
1261 ggacacggat ggcctcgacg cgggactgca gtacttcgcg
     atggacgggc gtgaggtgcg
1321 ccgcttcgtc acggagcacc tgccgcagct gatcaagggc
     ttcctgcacg aggccggggt
1381 cgacgccgcc gacatcagcc acttcgtgcc gcatcaggcc
     aacggtgtca tgctcgacga
1441 ggtcttcggc gagctgcatc tgccgcgggc gaccatgcac
     cggacggtcg agacctacgg
1501 caacacggga gcggcctcca tcccgatcac catggacgcg
     gccgtgcgcg ccggttcctt
1561 ccggccgggc gagctggtcc tgctggccgg gttcggcggc
     ggcatggccg cgagcttcgc
1621 cctgatcgag tggtagtcgc ccgtaccacc acagcggtcc
     ggcgccacct gttccctgcg
1681 ccgggccgcc ctcggggcct ttaggcccca caccgcccca
     gccgacggat tcagtcgcgg
1741 cagtacctca gatgtccgct gcgacggcgt cccggagagc
     ccgggcgaga tcgcgggccc
1801 ccttctgctc gtccccggcc cctcccgcga gcaccacccg
     cggcggacgg ccgccgtcct
1861 ccgcgatacg ccgggcgagg tcgcaggcga gcacgccgga
     cccggagaag ccccccagca
1921 ccagcgaccg gccgactccg tgcgcggcca gggcaggctg
     cgcgccgtcg acgtcggtga
1981 gcagcaccag gagctcctgc ggcccggcgt agaggtcggc
     cagccggtcg tagcaggtcg
2041 cgggcgcgcc cggcggcggg atcagacaga tcgtgcccgc
     ccgctcgtgc ctcgccgccc
2101 gcagcgtgac cagcggaatg  tcccgcccag ctccgga
```

In some embodiments, the 3-ketobutyryl-CoA synthase of the present invention is a homolog to a synthase comprising a protein sequence of any one of SEQ ID NOs. 1-120, as shown in Table 1 below. In some embodiments, the 3-ketobutyryl-CoA synthase of the present invention is a 3-ketoacyl-CoA synthase that comprises an amino acid sequence having at least about 70%, about 75%, about 80%, about 85%, about 90%, about 92%, about 94%, about 96%, about 98%, or about 99%, but less than 100% or about 100% homology to any one of SEQ ID NOs. 1-120. In some embodiments, the method herein comprises selecting at least two of 3-ketoacyl-CoA synthases, wherein each synthase occupies a different branch of a phylogenetic tree. In one aspect, the present invention provides a library of NphT7 homologs herein selected by a method herein.

In some embodiments, the 3-ketovaleryl-CoA synthase of the present invention is a homolog to a synthase comprising a protein sequence of any one of SEQ ID NOs. 1-120, as shown in Table 1 below. In some embodiments, the 3-ketovaleryl-CoA synthase of the present invention is a 3-ketoacyl-CoA synthase that comprises an amino acid sequence having at least about 70%, about 75%, about 80%, about 85%, about 90%, about 92%, about 94%, about 96%, about 98%, or about 99%, but less than 100% or about 100% homology to any one of SEQ ID NOs. 1-120. In some embodiments, the method herein comprises selecting at least two of 3-ketoacyl-CoA synthases, wherein each synthase occupies a different branch of a phylogenetic tree. In one aspect, the present invention provides a library of NphT7 homologs herein selected by a method herein.

TABLE 1

Synthase Sequences

| SEQ ID NO | FASTA Header | Protein sequence |
|---|---|---|
| SEQ ID NO: 3 | >gi\|18310050\|ref\|NP_561984.1\|/1-324 3-oxoacyl- | MKNAKMIGFGLYTPKNLVENERLQEFLETSDEWIRTRTGIERRYI SLDENTSDLAVEASKKALSQARLSAEEIDLIIVATVTPDNFTPSTA CIVQDKLGAKNAWAFDINAACTGFIYALKLGRSLIRSGEANNALI |

TABLE 1-continued

Synthase Sequences

| SEQ ID NO | FASTA Header | Protein sequence |
|---|---|---|
| | ACP synthase [*Clostridium perfringens* str. 13] | IGAETLSKALNWEDRGSCVLFGDGAGATVLTSTEEDCGIKCVNV KSDGSKGDSLVIQGLPLNSPFKDGREVSENYINMMGREIFKFATK VMEESIVEILEKENIKIEDIAAIIPHQANLRIIDYVVKRLGIPREKFIT NLQNYGNTSGASIPIALCESIDEGNLKKGDNIIMVGFGGGLTWGA ALIKL |
| SEQ ID NO: 4 | >gi\|21224866\|ref\| NP_630645.1\|/1- 316 3-oxoacyl- ACP synthase [*Streptomyces coelicolor* A3(2)] | MHQGSRITAVGHYQPARILTNEDLAGMVDTSDEWIRSRVGIRTR RIAGPDEPVDELAGHAAAKALASAGLTPADVDLVVVATSTAIDR SPNTAARVAARLGIPGPAALDLNVVCAGFTHALATADHAVRAGS ASRALVVGADKMSEVVDWTDRTTCVLVGDGAGAAVVEACAPG EEPGIGPVLWGSVPEMGNAVRIEGTPPRFAQEGQSVYRWATTRL PAIARQACERSGLEPADLAAVVLHQANLRIVEPLAAKIGAVNAV VARDVVESGNTSAASIPLALSKLAERGEITTGDPALLFGFGGNLS YAGQVVRCP |
| SEQ ID NO: 5 | >gi\|23014672\|ref\| ZP_00054477.1\|/1- 324 COG0332: 3-oxoacyl-[acyl- carrier-protein] synthase III [*Magnetospirillum magnetotacticum* MS-1] | MIVRSQIIGCGSYLPSRLVTNAELAAKVDTTDEWIVERSGIRQRHI AAEGETTSDLATNAALRALEAAGIAGSAVDLVIVATATPDNTFPA TATKVQSRIGMKHGFAFDVQAVCSGFVYALSVADNFIKSGQVQT ALVIGAETFSRILDWNDRTTCVLFGDGAGAVVLRANRGKGSSAD RGILSTHLHSDGSHYDLLYVDGGPSSTQTVGHVHMEGREVFRHA VINLASVVGEALSANDLKASDIDWVVPHQANRIIEGTAKKLGFP LDKMVMTVDRHANTSAASIPLALTEAVSDGRIKPGQLVLLEAMG GGFTWGSALVRM |
| SEQ ID NO: 6 | >gi\|28898830\|ref\| NP_798435.1\|/1- 316 3-oxoacyl- ACP synthase [*Vibrio parahaemolyticus* RIMD2210633] | MYSKILGTGSYLPSQVRTNADLEKMVDTSDEWIVARTGIKERRIA AEDETVADMAFYAAENAIDMAGIDKNDIDLIIVATTSSSHTFPSSA CQVQAKLGIKGCPAFDLAAACSGFVYALSVADQHIKSGMCKNV LVIGADALSKTCDPTDRSTIILFGDGAGAVVVGASQEPGIISTHIY ADGQFGDLLSLPVPERGKDVDKWLHMAGNEVFKVAVTQLSKLV KDTLEANDMHKSELDWLVPHQANYRIISATAKKLSMSLDQVVV TLDRHGNTSAATVPTALDEAVRDGRIKRGQTLLLEAFGGGFTWG SALVKF |
| SEQ ID NO: 7 | >gi\|56419339\|ref\| YP_146657.1\|/1- 310 3-oxoacyl- ACP synthase [*Geobacillus kaustophilus* HTA426] | MGAGIIGVGRYVPEKVLTNFDLEKMMDTSDEWIRTRTGIEERRIA ADDIDTSDMAYFAAKRALQDAGMEAKDIDLILVATVTPDRPFPS VACMLQERLGAVNAAALDISAACAGFMYGMVTAAQFIDTGAY KYILVVGADKLSKITDWTDRNTAVLFGDGAGAVVMGPVSPGRGI LSFELGADGTGGKHLYKDEYIVMNGREVFKFAVRQMGESSVRV LEKAGLTKDDVDFLIPHQANIRIVEAARQRLELPEEKISTTIRRYG NTSAASIPISLVEELEAGKIHDDDLIIMVGFGGGLTWGAIALRWG R |
| SEQ ID NO: 8 | >gi\|65318552\|ref\| ZP_00391511.1\|/1- 308 COG0332: 3-oxoacyl-[acyl- carrier-protein] synthase III [*Bacillus anthracis* str. A2012] | MGILGIGRYVPEKVVTNHDLEKIMDTSDEWIRTRTGIAERRIADD TIDTSYMAVEASKKALEDAGISGEDIDLILVATVTPDRAFPAVAC VIQEAIGAKHAAAMDLSAACAGFMYGMITAQQFIQTGTYKNVL VVGSDKLSKIVDWNDRNTAVLFGDGAGAIVMGAVSEGKGVLSF ELGADGSGGKHLYQDEYVMMNGREVFKFAVRQLGDSCLRVLD KAGLTKEDVDFLVPHQANIRIMESARERLNLPQEKMSMTIEKFG NTSASSIPIAMVEELQNGRIQDGDLIILVGFGGGLTWGAVALRWG K |
| SEQ ID NO: 9 | >gi\|86159172\|ref\| YP_465957.1\|/1- 326 3-oxoacyl- ACP synthase [*Anaeromyxobacter dehalogenans* 2CP-C] | MRSLIAGTGSYAPEKVVTNADLEKLVDTNDQWIVERTGIRERHV VADDQATSDLALEASRRALDAAGLDAKDVEMIVVGTVTPDYPF PSVGAVLQGKLGNKKAFAFDVSAACAGSLYALSVADRFVASGA VKNALVVGADALTRITDWTDRNTCILFGDGAGAMVLKPTDDPQ RGIRAVRLHADGSLVPILLQPGGGSRDPISEKVVREKSHYVKMN GREVFKVAVRSLEESCREVLADEKLTPGDVTWVIAHQANKRILD ATLHRLEIPESKCWMNLEKYGNTSAASVPMTLDEANRAGWLKP GDTVLMMAIGGGMAWGASVVRW |
| SEQ ID NO: 10 | >gi\|93006238\|ref\| YP_580675.1\|/1- 381 3-oxoacyl- ACP synthase [*Psychrobacter cryohalolentis* K5] | MTTCITGTGLYIPPFSISNEELVESFNQYVEKYNTKHAADIEAGTL TALQPSSAAFIEKVSGIKSRYVMEKDGILNPDIMAPVIAYRNLGEE LSIMAEMGVAALNDALADAGLEANDLDGIILACSNFQRTYPAVSI EIQNAIGMVGGFAYDMNVACSAATFGLSQAHGSIASGLAKRVAV VNVEITSAHLNWRNRDSHFIFGDVATACIVEELDTPKGYEILNSK LFTQFSTNIKNEYGFMDRSEFLAAQTEMYPDIKEPVTDKLFLQNG RKVFREVCPKVSEVITEHLQENNIATSDVKMMWLHQANANMLD LILRTVIGKEADKAIVPSVIAEFANTSSASPMIVFHRYKDDLASGD LGVICSFGAGYSIGSVIVRKV |
| SEQ ID NO: 11 | >gi\|109899602\|ref\| YP_662857.1\|/1- 374 3-oxoacyl- ACP synthase | MTNSVVISGSGLWNPPHSISNEELVDAYNAYAQQFNEQNADEIES GAITAKPFSSAEFIQKASGIRSRYCYMKDGVLDINRMRPIIPERGE EELSDAEMAINAAKLALEAANKTAEDIDVVIVSCAYTQRSYPA LAIEVQGALGIKGFGFDMLVACSAATFALHRAYEMISAGTAKGV |

TABLE 1-continued

Synthase Sequences

| SEQ ID NO | FASTA Header | Protein sequence |
|---|---|---|
| | [*Pseudoalteromonas atlantica* T6c] | LVINPELTSPQVNYCDRDSHFIFGDVATAMVVEHADTATSEHVF DILSTKAITQYSNNIRSNFGYVSRANDVDPYGADKLFHQEGRKVF KEVCPMAAEHISEHLERHQLTSADVKRWWLHQANINMNTLISKR LLGREATVEEAPIVLDRYANTASAGSIIAFNLHHKDLQAGDYGLL CSFGAGYSIGSLLVRKR |
| SEQ ID NO: 12 | >gi\|114047960\|ref\| YP_738510.1\|/1- 319 3-oxoacyl- (acyl carrier protein) synthase III [*Shewanella* sp. MR-7] | MHTKILGTGSYLPVQVRSNQDLEKMVETSDQWIVERTGISERRIA AQDETVSTMGYQAALKALEMAGIEASELDMIICGTTSAANAFPA AACEIQAMLGVHTIPAFDIAAACSGFVYALSVADQFVKNGTAKK VLVIGADVLSRLCEPEDRTTIILFGDGAGAAVIGASDEPGIISTHIY ADGRQGDLLKCAFPPRQGETSEAVGFMTMKGNDVFKVAVTQLS HVVTETLRLNNIDKSEIDWLVPHQANFRIINATAKKLDMSLDKV VLTLAKHGNTSAASVPIALDEAVRDGRIQRGQLLLLEAFGAGFA WGSALVRF |
| SEQ ID NO: 13 | >gi\|121533809\|ref\| ZP_01665636.1\|/ 1-338 3-oxoacyl- (acyl-carrier- protein) synthase III [*Thermosinus carboxydivorans* Nor1] | MKANDIGVGILGLGCYVPEKVLTNHDLEKMVDTSDEWIVERTGI RERRIADPDVATSDLIAERALSNAGISADELDLIIVATATPD MFFPSVACLVQDNLKATRAAAFDLVAGCSGFVYGLTVGAQFIKT GLYKKVLVIGAETSKILDWTDRNTCVLFGDGAGAAVLSETEPG YGLIGFHLGADGSGGDLLKLPAGGSRLPPSVETVTQRLHFVHMN GNEVFKFAVRVMGEAAVKALENAGLGHQDVDCLIPHQANIRIIQ SAAKRLKLPMDKVIVNVDKYGNTSAASIPIALEEAVRNGRVKKG DVVVLVGPGAGLTWASCVIKWCKEDNTIA |
| SEQ ID NO: 14 | >gi\|146293464\|ref\| YP_001183888.1\|/ 1-373 3-oxoacyl- ACP synthase [*Shewanella putrefaciens* CN- 32] | MKQVVISGSGLFTPPYSISNEALVESFNAYVDIFNLENAGLIEQGH VAALSYSSSEFIEKASGIKHRYVMVKEGILDPEIMMPLIPERSSDE LSMQAEIGVEAALMALNNANLKAEQIDLVIVACAYTQRAYPAM AIEIQRALGTRGYGYDMQVACSSATFAIVAAANAIATGSASRVLV INPEICSAQVNYRDRDSHFIFGDVATALVLEEQSLVEPNKGFTILS SRCFTDYSNNIRSNFGFLNRCDPSSAHQADKLFHQQGRKVFKELL PMIYQHLDEHLAEQASTPQSFKRLWLHQANINMNQFVVRKMLG DEVSPEQAPVVLDEYANTASAGSVIAFHKYSSDFKAGDLGLLSSF GAGYSIGSVILQKR |
| SEQ ID NO: 15 | >gi\|160900704\|ref\| YP_001566286.1\|/ 1-325 3-oxoacyl- ACP synthase [*Delftia acidovorans* SPH- 1] | MRRYARITGTGSYLPPRRLTNHDLAAELAQRGIETSDEWIVERTG IHARHFAAPDVASSDLALEASKKALEAAGCQPQDIDLIIVATSTPD MVFPSTACILQNKLGANGCAAFDVQAVCSGFVYALTVADAMIQ SGAASRALVVGSEVFSRILDFNDRTTCVLFGDGAGAVVLEASEQ PGILASDLHADGKHVGILCVPGNVSGGQVLGDPLLKMDGQAVF KLAVGVLEKAARATLDKAGLTDADIDWLIPHQANIRIMQSTARK LKLSMDKVVVTVDQHGNTSAASIPLALDHGVRNGQVKPGQTVL LEGVGGGFTWGAVLLKM |
| SEQ ID NO: 16 | >gi\|166364688\|ref\| YP_001656961.1\|/ 1-333 3-oxoacyl- ACP synthase [*Microcystis aeruginosa* NIES- 843] | MNGFGAAVVITGCGSATPAQFLSNEELSQIVETSDEWIKSRTGIG KRHLADRSVSLSQLAAQAAIKALEMAQVSPRDIDLILLATSTPDD LFGSAAQVQSQIGANRAIAFDLTAACSGFLVGLVTATQFIRTGTY RNVLVIGADVLSRWVDWNDRATCVLFGDGAGAVVCQANDTKD NILGFELHSDGSQNGSLNLAYEGEELPLKQGIRVQKGTYKPLRM NGREVYRFAVAKVPEVIEKALYRANLTTSDIDWLVLHQANQRIM DAVSERLKLPPEKVISNLSEYGNTSAASIPLALDEAVRSGKVKKG DIIASSGFGAGLTWGGIIFRWGD |
| SEQ ID NO: 17 | >gi\|169633183\|ref\| YP_001706919.1\|/ 1-368 3-oxoacyl- ACP synthase [*Acinetobacter baumannii* SDF] | MGIRITGTGLFHPTEIISNEELADSLNAYVEQYNQENAEKIAAGEL EELRGSSAEFIEKASGIKRRYVIEKSGILDPTRLRPRLSERSNDELSI QAEWGVIAAKQAMENAGVTAEDIDVVILACSNMQRAYPAVAIEI QSALGIQGYAYDMNVACSAATFGLKQAADAIRSGARRVLLVNV EITSGHLDYRNRDCHFIFGDVATASIIEETTTKTGFEILDIHLFTQFS NNIRNNFGPLNRSEDAVVDDKLFRQDGRKVFKDVCPLVAKIINA QLEKMQLTANDIKRFWLHQANANMNELILKYVAGKDADLSRTP IILDEFANTSSAGVIIALHRTGHEVDDGEYGVISSFGAGYSVGSIV VQKHVA |
| SEQ ID NO: 18 | >gi\|170781992\|ref\| YP_001710324.1\|/ 1-324 3-oxoacyl- ACP synthase [*Clavibacter michiganensis* subsp. *sepedonicus*] | MVERFTRIWGLGAARGELDVPNDDLVGPIDSSDEWIRQRTGIITR KRAGADVDAVDLATTASLEAIAKAGIRPEQIGIVLVSTVSNTVQT PSMAALLADRIGANPAPAYDISAACAGYTGIAQADSFIRSGLAE YVLVVGAEKLSDIVDPTDRSISFLLGDGAGAAIVGPSDTPGISPTV WGSDGSNWDAVGMTGTLKSMRDGSAWPTLRQDGQKVFRWAV WEMVKVAKEALDRAGVAPEQLAAFIPHQANMRIVDEFAKQLGL PESVAIARDIATTGNTSAASIPLATHRLLEEDPSLSGGLALQIGFGA GLVFGAQVVVLP |
| SEQ ID NO: 19 | >gi\|197104835\|ref\| YP_002130212.1\|/ 1-370 3-oxoacyl- ACP synthase [*Phenylobacterium* | MNDAVIAATGLYTPPLSLSNAELVETFNAYVERFNAANAEAIAR GEVQPLQPSSVEFIEKASGIKSRFVVDKTGLVDPEIMRPIIPERPND QLSILAEIAVEAAKDAIARWGKPVSEIDAVICAASNMQRAYPAM AIEVQQALGIDGFAFDMVACSSATFGIKTAADFVAGGAKAVLM VNPEICSGHLNFRDRDSHFIFGDVATAVIVERADQATDGWDILGT |

TABLE 1-continued

Synthase Sequences

| SEQ ID NO | FASTA Header | Protein sequence |
|---|---|---|
| | *zucineum* HLK1] | RLKTQFSNNIRNNFGFLNRADPEGVGKPDKLFVQEGRKVFREVV PMVSEMIVDHAADLGIDPTGLKRLWLHQANINMNEMIGRKVLG RDPAPGENVIILDEYANTSSAGSIIAFHKANDDFQTGDTGLICSFG AGYSAGTVFVRKR |
| SEQ ID NO: 20 | >gi\|219849850\|ref\| YP_002464283.1\|/ 1-342 3-oxoacyl- (acyl-carrier- protein) synthase III [*Chloroflexus aggregans* DSM 9485] | MYDRKVARVSRERYAAVIGWGMAVPNRVVTNDDLAQRIDTSD EWIRTRTGIRERRVAGPGESTSTFATAAGREALEMAGVSPATIDT VIVATCTPDRPFPATACTVQANLQIPRATAFDLAAACSGFVYGLT VATSLIKSGVSRRLLLIGADIFTHYINWNDRNTCVLFGDGAGAVV LEATDEPLGLIASNLSADGNLEDLMAVDAGGTRMPLTAELLAEG RQYVYMNGREIFKHAVREMSESALHVVQAAGLTIDDIALVIPHQ ANVRIIDAVARRLELPPERVMINLDRYGNTSAASIPIALYEAAQQE RIKAGDYVLMTAFGGGLTWGSGIVRWGRPSR |
| SEQ ID NO: 21 | >gi\|227523050\|ref\| ZP_03953099.1\|/ 1-327 3-oxoacyl- (acyl carrier protein) synthase III [*Lactobacillus hilgardii* ATCC 8290] | MKFENFKILATASQVPTRVVDNDELSTMMDTSDDWIVQRTGIRR RHIAVDETTSSLCTSVAKQLLEKTGLKPSEIDLIIVATMSPDYLTPS VSAMVQGNLGADHAVAMDIDAACSGFVYGLNMVKQLLIAETPK NAILIGGEMLSKLIDWQDRSTAVLFGDGAGGVLLKNTPKAEGAFI SENLKTLGKLGRYLTAGKTGAPTPFMEKKDEFSPFFQMNGRRVY RFAVNNVPESINQALAEASLTTDDIDHFVLHQANSRIVEKIAETLG VSMDKFPINIDEYGNTAAASEPILLDQLVTNGTIKRGDVVLLSGF GGGLTVGTMILKY |
| SEQ ID NO: 22 | >gi\|238623523\|emb\| CAX48662.1\|/1- 327 putative 3- oxoacyl-[acyl- carrier-protein] synthase [*Streptomyces anulatus*] | MRMSDLGILGTGAYVPDRVVSNDDVGAAAGVDDAWIRRKTAIR ERRWAAPGQATSDLAAAAGRAALRSAGITADQLSVIVVATSTPD RPQPPTAAYVQHGLGAAGAAAFDVNAVCSGSVFALAVAEGLLA GRGGHALVIGADLYSRILNPADRRTVVLFGDGAGALVLGPAAQG PRVRHLALHTFGELAGLIEVPAGGSRLPGDRAALEAGLQYFAMD GREVRRFVAEQLPRLTKQFLHEAGVVPDDIGHFVPHQANGVLLD AVTDLGLPRAASHRTLAHYGNTGAASIPITLDTAARAGAFRPG DLILLAGFGGGMSAGLALVEW |
| SEQ ID NO: 23 | >gi\|239623103\|ref\| ZP_04666134.1\|/ 1-320 3-oxoacyl- [acyl-carrier- protein]synthase III [*Clostridiales bacterium* 1_7_47_FAA] | MTTRIIGTGSYVPEQIVTNNDLAQIVETNDEWIRSRTGIGERRIATT ESTSYMAANAAMRALEQSGVKPEEIDLILLGTSSPDYCFPNGACE VQGMIGAVNAACYDISAACTGFVYALNTAHAFISSGIYKTALVIG SDVLSKLIDWTDRGTCVLFGDGAGAVVVKADETGILGINMHSDG TKGNVLTCGSRTNGNFLLGKKPELGYMTMDGQEVFKFAVRKVP ECIKQVLDDAGVAAAEVRYFVIHQANYRIIESIAKRLKVSVDCFP VNMEHYGNTSGASVPLLLDEINRKGMLESGDKIVFSGFGAGLTW GATLLEW |
| SEQ ID NO: 24 | >gi\|240850683\|ref\| YP_002972083.1\|/ 1-324 3-oxoacyl- (acyl carrier protein) synthase III [*Bartonella grahamii* as4aup] | MIRSIIRGVGSALPKRSLSNDEIAKFVETSDSWIVQRTGIRQRYIAS ENETTVSLGVEAAQAALTNAGLTIKDIDCIILATSTPNRTFPASAV EIQCALGMSHGFAFDIQAVCSGIFIFALTTGDSYLRCGAAKRILVIG SDTFSRILDWEDRTTCVLFGDGAGAAILEAQEIEGGIAFERGILSA KLRSNGAYIDKLYVDGGPSTTQTTGYLRMEGREVFKYAVGMITD VVDDCFAAAGMDSSQLDWFVPHQANKRIIEASAKKLGISLDKVV ITVDQHGNTSAASVPLALTTAVCDGKIKEGDLIMLEAMGGGFTW GAILIRW |
| SEQ ID NO: 25 | >gi\|253681256\|ref\| ZP_04862054.1\|/ 1-324 3-oxoacyl- [acyl-carrier- protein]synthase 3 [*Clostridium botulinum* Dstr. 1873] | MYNVKIISTGKYIPDNVVTNDDMSKFVDTNDKWISERTGIKERRI STGENTSHMAVKAALAALEKSSVKATDLDLIIIATCTPDSFVPSTA CIVQDKLGATKATCFDISAACTGFIYALGVASQFIKTGQVKNALV IGAETLSKILNWEDRSTCILFADGAGAAIIERSEEVGLISQYTGSDG TGGKALKCEALPVRNPYCKVDDKFKDTLSMEGREVFKFAVNAM IESINKVLENTEYTLDDDIDYIVPHQANIRIIEFVSKKLGISQDKFYV NLHKYGNTSGASIPIALDEMNKKGMFKKGDNIILVGFGGGLTFG AHLIQWN |
| SEQ ID NO: 26 | >gi\|254286853\|ref\| ZP_04961806.1\|/ 1-312 3-oxoacyl- (acyl-carrier- protein) synthase III [*Vibrio cholerae* AM- 19226] | MYSKILGTGSYLPSQVRTNADLEKMVETSDEWIVARTGIRERRIA ADNETVADMAFFAAQNAIDMAGIDKHDIDMIIVATTSASHTFPSA ACQVQGKLGIKGCPAFDLAAACSGFMYALSIADQHVKSGMCKH VLVIGADALSKTCDPTDRSTIILFGDGAGAVVVGASNEPGILSTHI HADGEFGDLLSLEVPVRGGDSDKWLHMAGNEVFKVAVTQLSKL VVDTLKANNMHKSELDWLVPHQANYRIISATAKKLSMSLDQVVI TLDRHGNTSAATVPTALDEAVRDGRIQRGQMLLLEAFGGGFTW GSA |
| SEQ ID NO: 27 | >gi\|254477647\|ref\| ZP_05091033.1\|/ 1-323 3-oxoacyl- (acyl-carrier- protein) synthase III [*Ruegeria* sp. R11] | MTRRAVIAGIGHYLPERIVENAEFEATLDTSDEWIRSRSGIERRHF AAEGETTSNMATKAAQNALADAGMTADDIDAIVVATSTADLTF PSAATMVQALGMTKGFAPDVQACAGFVYALSNANALVASG QADKVLVIGAETFSKIMDWTDRSTCVLFGDGAGALVLEAQEGA GTSDDRGILATDLNSDGRFKDLLYVDGGVSTQNTGHLRMQGNQ VFRHAVEKLASTAHTSLERAGLGADDVDWIVPHQANIRIIQGTA KKMGLPMDKVVVTVQDHGNTSAASIPLALSVGKARGQIKQGDLI VTEAIGGGLAWGSVVLRW |

TABLE 1-continued

Synthase Sequences

| SEQ ID NO | FASTA Header | Protein sequence |
|---|---|---|
| SEQ ID NO: 28 | >gi\|262375396\|ref\|<br>ZP_06068629.1\|/<br>1-369 3-Oxoacyl-<br>[acyl-carrier-<br>protein (ACP)]<br>synthase III<br>family protein<br>[Acinetobacter<br>lwoffii SH145] | MGIRITGTGLFHPEHVITNEELVESLNAYVELFNHENADKIAAGE<br>VEARRGSSADFIEKASGVQRRYVVEKSGILDPKRLRPNLRERADD<br>EISLQAEWGVIAAKQAMENAGVTAEDIDIVILSCSNLQRAYPAVA<br>IEIQTALGIKGYAYDMNVACSAATFGLKQAYDAIKAGARRVLLV<br>NVEITSAHTDFRSRDCHFIFGDVATASIIENTDSKTGFEILDSELFT<br>QFSNNIRNNFGFLNTSENADIDDKRFRQDGRKVFKEVCPLVAKMI<br>TAQLEKNQIEPTGVKRFWLHQANASMNELILKLVVGKENAKPGL<br>VPIILNEFANTSSAGVIIALHRTAHEVEDGEYGVLCSFGAGYSVGS<br>ILVQKRVA |
| SEQ ID NO: 29 | >gi\|282854072\|ref\|<br>ZP_06263409.1\|/<br>1-332 3-oxoacyl-<br>[acyl-carrier-<br>protein]synthase<br>3<br>[Propionibacterium<br>acnes J139] | MTAIKTRPVHGYSKFLSTGSARGSRVVTNEEMCTLIDSTPEWIEQ<br>RTGITERRWATSSETVASMGTTAARTALERSGLEASQIDAIIVATV<br>SHHRPSPSLAAYIARELGLGDAAAFDLNGACAGFCYSTALADSM<br>IRTGSANYVLVIGVEKLSEMTNLDDRSTAFLFSDGAGAAIISASDE<br>PGIGPVVWGSRSDQLKTIELEDWPTASADPNKIHPLIRMEGRAVF<br>KWAMTDVAKRAAEAVAEAGITPADLDVFIPHQANDRITDVVSR<br>HLKLPESVTVCHDIADMGNTSAASVPIAIDRMLQRGQAHSGDLA<br>LIIGFGAGLVYAGQVIRLP |
| SEQ ID NO: 30 | >gi\|291439887\|ref\|<br>ZP_06579277.1\|/<br>1-333 3-oxoacyl-<br>(acyl carrier<br>protein) synthase<br>III [Streptomyces<br>ghanaensis ATCC<br>14672] | MAKIKPSKGAPYARILGVGGYRPTRVVPNEVILETIDSSDEWIRSR<br>SGIETRHWASPEETVAAMSVEASGKAIADAGIDAAQIGAVVVST<br>VSHFAQTPAIATEIADRLGTDRAAAFDISAGCAGFGYGLTLAKG<br>MVVEGSAEYVLVIGVERLSDLTDLEDRATAFLFGDGAGAVVVGP<br>SQEPAIGPTVWGSEGDKSETIKQTVPWTDYRDGTVEKFPAITQEG<br>QAVFRWAVFEMAKVAQQALDAAGITADDLDVFIPHQANVRIIDS<br>MVKTLKLPEHVTVARDIRTTGNTSAASIPLAMERLLATGEAKSG<br>DTALVIGFGAGLVYAASVVTLP |
| SEQ ID NO: 31 | >gi\|294791665\|ref\|<br>ZP_06756813.1\|/<br>1-331 3-oxoacyl-<br>(acyl-carrier-<br>protein) synthase<br>III [Veillonella sp.<br>6_1_27] | MTMMNKPVGIIGTGSFLPDNVVTNFDLEKMVDTNDQWIRERTGI<br>EERRIAPEGMNTSYMATEAAKKAMQMANVTAEEIDMIIFATLTP<br>DMIIPSAACVLQANLGAKNAAAYDLQAACSGFVYGLITAASYISS<br>GIYKKVLVVGAEILSRRVNWNDRGTCILFGDGAGAAVVSEVPEG<br>YGIKGIDMGADGTGGSALCIPAGGTAVVANDQRVEEGLTFIHMD<br>GPEVYKFAVKTMGRTVLKSLERASMELNELDYFIPHQANIRIIDS<br>AAKRLHLPMEKVFVNLHKYGNTSAASVAIALDEANREGRFKRG<br>DNVAFAGFGAGLTWASLVLKWY |
| SEQ ID NO: 32 | >gi\|296388215\|ref\|<br>ZP_06877690.1\|/<br>1-373 3-oxoacyl-<br>(acyl carrier<br>protein) synthase<br>III [Pseudomonas<br>aeruginosa PAb1] | MHKAVISGTGLYTPPYSISNDELVESFNTFVRQYNDQHAEAIAKG<br>ELEALAESSSAFIEKASGIKSRFVMNKEGILDPQRMVPYLPERSND<br>EWSILCEMAVAAAREALQRAGRSAADIDGVIVACSNLQRAYPAI<br>AVEVQAALGIQGYGYDMNVACSSATFGIQAATTAIQTGQARAIL<br>MVNPEICTGHLNFRDRDSHFIFGDACTAVIVERADLAVSKHQFDI<br>VSTRLLTQFSNNIRNNFGFLNRADESGIGKRDKLFVQEGRKVFKD<br>VCPMVAELIGEHLAANEIQVAEVKRFTVLHQANLNMNLLITRKLL<br>GRDAEAHEAPVILDSYANTSSAGSVIALHKHQDDLPSGAIGVLSS<br>FGAGYSIGSVILRKH |
| SEQ ID NO: 33 | >gi\|302539498\|ref\|<br>ZP_07291840.1\|/<br>1-343 3-oxoacyl-<br>[acyl-carrier-<br>protein]synthase<br>III [Streptomyces<br>sp. C] | MTAIGILGTGSYLPADTVSNRVVGERAGVTEDWILQKTGIRERRY<br>AAEYEATSDLAVEAARSALDAAGISAEQLSWIVVATSTPDSPQPA<br>TACLVQHRIGAVNAAAFDVNSVCSGFVFGLVAAARMLPGQDGG<br>VRGHALVIGADVYSRIIDREDRRTAVLFGDGAGAVVLGPVRSGY<br>GVLGSYLASRGDQAELIRVEAGGSRLPASEKTVAEGLHHFRMNG<br>RGVRDFVAAELPRAVGEVLDRHGLERSEVDHFVPHQANGVMLG<br>ETVPRLGLPRARTHLTVAEHGNTSAASIPLALDEAYRSGAFRDRD<br>VVLLAGFGGGMSLGTVLVRWDEEAAPAPRKDSAA |
| SEQ ID NO: 34 | >gi\|307083025\|ref\|<br>ZP_07492138.1\|/<br>1-313 3-oxoacyl-<br>[acyl-carrier-<br>protein]synthase<br>III fabH, partial<br>[Mycobacterium<br>tuberculosis<br>SUMu012] | MTEIATTSGARSVGLLSVGAYRPERVVTNDEICQHIDSSDEWIYT<br>RTGIKTRRFAADDESAASMATEACRRALSNAGLSAADIDGVIVTT<br>NTHFLQTPPAAPMVAASLGAKGILGFDLSAGCAGFGYALGAAAD<br>MIRGGGAATMLVVGTEKLSPTIDMYDRGNCFIFADGAAAVVVG<br>ETPFQGIGPTVAGSDGEQADAIRQDIDWITFAQNPSGRPFVRLEG<br>PAVFRWAAFKMGDVGRRAMDAAGVRPDQIDVFVPHQANSRINE<br>LLVKNLQLRPDAVVANDIEHTGNTSAASIPLAMAELLTTGAAKP<br>GDL |
| SEQ ID NO: 35 | >gi\|311113478\|ref\|<br>YP_003984700.1\|/<br>1-341 3-oxoacyl-<br>(acyl-carrier-<br>protein) synthase<br>III [Rothia<br>dentocariosa<br>ATCC 17931] | MTTLKQYENNRYSRILGYGASRGEVIVHNNDIVEAINSSDEWIKQ<br>RTGISTRHRASENQTVNDLAIAAAHDALANSHVTGEQIDAVIISTI<br>SHPYATPSLAVLVADAIGSRCPAYDISAACAGFCYGIAQADAMV<br>RSGMAQNVLVIGVEKLSLKPIDNTERSISFLLGDGAGAAVVSVSDE<br>PGIAPTIWGSDGSRWGTVGMTHSLLDIRNRDFVVNPVQEDEKIW<br>PTLRQDGPSVFRWAVWEMAKVAQQALESAGITPDELGALIPHQA<br>NARIIDQMAKTLKLPENVAIARDIADAGNTSAASVPLAAHRLLQE<br>QPELSGKFALQIGFGAGLAYAAQVVVLP |

TABLE 1-continued

Synthase Sequences

| SEQ ID NO | FASTA Header | Protein sequence |
|---|---|---|
| SEQ ID NO: 36 | >gi\|312793335\|ref\|YP_004026258.1\|/1-328 3-oxoacyl-(acyl-carrier-protein) synthase iii [Caldicellulosiruptor kristjanssonii 177R1B] | MKQNVKILSTGRFVPEKILSNYDLEKMVETSDEWITQRTGIKERR IVDGRTSTTDLAVQAARNAMQKAGISPDEIDLVIVATVTPEMFFP STACLVQKELKLKNAFAFDISAACSGFIYGMAVATQFIQNGFCKT ALVIGAEALSKITNWSDRSTCVLFGDGAGAAILTASSEEGILGFEL GSDGENGLLLYCHAFGLSDLSYSQFKDMPNFRKIYMDGNEVYKF AVKIMPYAVEKVLEKVGLSSSDIDVFIPHQANIRIIESAAKRLKIP MEKVFVNLHKYGNTSAASIPIALDEAIEEGRIKKGDRIVLVGFGG GLTWASCAVKWI |
| SEQ ID NO: 37 | >gi\|318080591\|ref\|ZP_07987923.1\|/1-307 3-oxoacyl-(acyl-carrier-protein) synthase III [Streptomyces sp. SA3_actF] | MDNSELCATVASTPEWIETRSGIRARGFAAPDETLRFMGRAAAE KALARAGVLPDGIDLVLVASMSRLEQTPPLAVLLAEDLGARAAA GLDVSGACAGFCHALALASDAVRAGSARHVLVVGTERMTDLVE RADRTVSVLFADGAGAAVVGPSARPGISPPARGAAGRYAGALR MDRGWDAFAADPSLGRPWMRMDGRRVFRWAMDEVTPRAAEL LRESGIEPEALDAFVPHQANLRMIELMAERLGLPERTAVARDVV RAGNTSAASVPLALEALLDSGEVGSGDRALLVGFGAGLNYAAQ VVELP |
| SEQ ID NO: 38 | >gi\|320116117\|ref\|YP_004186276.1\|/1-331 3-oxoacyl-(acyl-carrier-protein) synthase III [Thermoanaerobacter brockii subsp. finnii Ako-1] | MCEKIAAGILGTGSYVPEKVLTNFDLEKMVDTSDEWITTRTGIKE RRIADPSQATSDLATEAAKKALEDAKVDPSEIDMIIVATVTPDMN FPSTACIVQANLGAANAAAFDISVGCSGFIYGLAIAQQFVETGMY NKILVIGAETLSKIINWKDRNTCVLFGDGAGAVVVGRVESGYIL SSYLGADGTGGKHLYMPAGGSRMPASEETVKKNLHTIFMEGQE VFKFAVKVMDSATIEALNRCGLKPEDIDMLIPHQANTRIIEAARK RLKLSNDKVYINLDKYGNTSAASVAIALDEAYRKGLIKKGDVILT VAFGAGLTWASSVIRWSK |
| SEQ ID NO: 39 | >gi\|320449672\|ref\|YP_004201768.1\|/1-322 3-oxoacyl-ACP synthase [Thermus scotoductus SA-01] | MSGILALGAYAPERVMKNEEFEAYLDTSDEWIVTRTGIRERRIAA EDEYTSDLAFKAVEDLLGRHPGALEGVDGVIVATNTPDALFPDT AALVQARFGIQGFAYDLLAGCPGWLYALAQAHAMVEAGLARK VLVVGAEALSKIVDWNDRATAVLFGDAGGAAVVGKVSKGFGFR SFVLGADGTGAKELYHACVARPLPDGTSMRNRLYMNGREVFKF AVRVMNTATLEAIEKAGLTPEDIKVFVPHQANLRIIDAARERLGL PWERVVVNVDRYGNTSASIPLALKEAVDEGRIREGDHVLLVSF GAGLTWAAAVITWGGA |
| SEQ ID NO: 40 | >gi\|322421910\|ref\|YP_004201133.1\|/1-326 3-oxoacyl-(acyl-carrier-protein) synthase III [Geobacter sp. M18] | MIRAEILGTGGFVPARVVPNAHFNYLVDDADQWIHSRTGIRERRF ASAEEEATSDLATNAALLALENGDVDPLEIDCIIVSTSTPDMILPAT ACMVQKNIGAAKAFAFDMNAVCSSFIYGMEVADNLIRSGKYRK VLLIGADTYSKILDFDDKGSAPLFGDGAGAVILGAGLSGKGILQS VMHSDGNGWELIQVPSSGSRKPVTAESIAAKENTFKMAGKSVFT FATDVIPRIISDLAERGGIRAEDIDHIIPHQANVRIIDFISRKTGIPKE KFLLNLDRYGNTAAASVGLALDENRRNGVIKSGELVLMMGFGG GLSWGGVLLKA |
| SEQ ID NO: 41 | >gi\|322513545\|ref\|ZP_08066645.1\|/1-316 3-oxoacyl-(acyl-carrier-protein) synthase III [Actinobacillus ureae ATCC 25976] | MYSKILATGSYLPAQIRTNADLEKMVDTTDEWIFTRSGMKERRIA AADETVATMGAQAAKKALEMAKIDHNEIDLIVVGTTTNSHAYPS AACQIQGMLEIKDAIAFDVAAACTGFVYALSVADQFVRTGKVKK ALVIGSDLNSRALDETDRSTVVLFGDGAGAVILEASEEQGIISTHL HSSSDSEYMLALPAQKRGNEKSGFIQMQGNATFKLAVGQLSSVV EETLEANNLQKSDLDWLVPHQANIRIIAATAKKLEMDSQVVLT VEKYGNNSAATVPVALDEAVRDGRIQRGQLLLLEAFGGGWTWG SALVRF |
| SEQ ID NO: 42 | >gi\|325677042\|ref\|ZP_08156713.1\|/1-345 3-oxoacyl-(acyl-carrier-protein) synthase III [Rhodococcus equi ATCC 33707] | MPAPIATATPAAHAALLGLGVYRPRRVVPNSEIVDRIDSSDEWIR TRSGITARGWAEPDETIVSMSVAAARDALAAAGLVAEQIDAVVL ATSSQMVLGPSAGAVVATELGMQDTAAFDISAGCAGFCYALGN AASLVRAGQARHVLVIGVERLSDLLDPTDRTCAFIFADGAGAVV VGPSDSEGIGPVAWGSDGSQTKAIKQDKDFMQYFAEVAAAEAA GGSTERPYIRMDGQAVFRWAITFLEKACRDALEKAGVTADDLD AFVPHQANSRITDALIRTLGLPDSVAVARDIAESGNTSAASIPMA MEQLLRSGEARPGDTALLLGFGAGLAYAGQVVQLPAIS |
| SEQ ID NO: 43 | >gi\|325917371\|ref\|ZP_08179586.1\|/1-325 3-oxoacyl-(acyl-carrier-protein) synthase III [Xanthomonas vesicatoria ATCC 35937] | MSKRIYSRIAGTGSYLPEKVLTNDDMSKIVDTSDEWIFSRTGIRER HIVADDQTTSDLAYFASLKAMEAAGVTADEIDLIVIGTTTPDLIFP STACLLQARLGNVGCGAMDVNAACSGFVYALSVADKFVRSGD AKTVLVVGAETLTRIVDWTDRTTCVLFGDGAGAVILKADEETGI LSTHLHADGSKKELLWDPVGVSVGFGEGKNGGGALLMKGNDV FKYAVKALDSVVDETLAANGYDKHDLDWLIPHQANLRIIEATAK RLDLPMEQVVVTVDRHGNTSSASVPLALDEAVRSGRVQRGQLL LLEAFGGGFTWGSALLRY |
| SEQ ID NO: 44 | >gi\|326203621\|ref\|ZP_08193485.1\|/ | MIKSTKSVGIIGTGSFVPEKVLTNNDLEKMVDTSDEWIIKRTGISE RRILDHDTPNYTMGIEAANRALEDAGLKAEDIDLLILSTEAPDYM |

TABLE 1-continued

Synthase Sequences

| SEQ ID NO | FASTA Header | Protein sequence |
|---|---|---|
| | 1-332 3-oxoacyl-(acyl-carrier-protein) synthase III [Clostridium papyrosolvens DSM 2782] | SPSMSCIIQGAIGAVNAIAFDLNAACTGFIYSLSVARQFIANGVYR NALVIGCEGLSKIVDWKDRNTCILFGDASGAVVLGEVDEGYGIL DSFLGSNGAEGMNITIPNLYLSEEEKAKRVNEKYNTLWMDGKEV FKFAVKAMSSATMHVLDNLNMDIKELDFIFPHQANTRIIDGAIKK LGITDDKIHYIINKYGNISSASIPVAMDEAKRDGKLKKGDNMVLV AFGGGLTWGSMAVKWSK |
| SEQ ID NO: 45 | >gi|332670773|ref| YP_004453781.1|/ 1-334 3-oxoacyl-(acyl-carrier-protein) synthase III [Cellulomonas fimi ATCC 484] | MTRPTLTQATGPAHSRILGIGGVRGERVVPNDDLVGPIDSSDEWI RQRTGIVTRRRAGEGTDVLDLAEGAARAAIENAGLTGADIDAVIL STVTYFHQTPAGAAIIADRIGATPAAAYDISAACAGYCYGIGQAD ALVRAGAARHVLVIGAEKMSEFVDPTDRSISFLLGDGAGAVVIGP SDTPGIGPTVWGSDGAQAQAIRQTHSWLATRDEGAGWPTLRQE GQSVFKWAVWQMAPVAQKALDAAGVTADQIDAFVPHQANMRI IDQMIKQLKLPETVVVGRDIADTGNTSAASIPLATERLLREGQVSS GALALQIGFGAGLVYAAQVVVLP |
| SEQ ID NO: 46 | >gi|339488784|ref| YP_004703312.1|/ 1-369 3-oxoacyl-ACP synthase [Pseudomonas putida S16] | MISGTGLYTPAQSISNEELVASFNTWSQQFNEDNAAAIERGEVEA APLSDAAFIEKASGIKSRFVMDKAGILDPQRMKPRLPERSNDEPS VLCEMAVAAARQALERAGRTAADVDGVIVACSNLQRPYPAIAIE VQQALGIQGFAFDMNVACSSATFGIQTAANSVALGQARAVLMV NPEVCTGHLNFRDRDSHFIFGDAATAVLLERADKATSAHQFDIVS SKLWTEFSNNIRNNFGFLNRAAEEGEGAADKLFIQEGRKVFREVC PKVAELIGEHLQENGLQPSDVKRFWLHQANLSMNHLIVKKLLGR EVAEEDAPVILDRYANTSSAGSVIAFHLYQDDLAKGSLGVLSSFG AGYSIGSVVLRKR |
| SEQ ID NO: 47 | >gi|339494943|ref| YP_004715236.1|/ 1-373 3-oxoacyl-(acyl carrier protein) synthase III [Pseudomonas stutzeri ATCC 17588 = LMG 11199] | MYNVVISGTGLYTPASSISNDELVESFNTYVHRFNSENAAAIEAG EVQPLAESSSAFIEKASGIKSRYVTDKAGILDPERMVPRIPERSND EWSILCEMSVKAAEEEALARAGKTAADIDGVIVACSNLQRAYPAI AIEVQAALGIKGFGFDMNVACSSATFGIQNAVNSIKLGQARAILM VNPEICTGHMNFRDRDSHFIFGDACTAVVIEREDLATSAHQWEV LSTKLVTEFSNNIRNNFGFLNRTAEEYMSNPDKLFIQEGRKVFKE VCPMVAELIGEHLSENGIAVESVKRFWLHQANLNMNHLIVRKLL GRDATEEEAPVILDYANTSSAGSVIAFHKHQDDLPSGSLGVLSS FGAGYSIGSVILRKR |
| SEQ ID NO: 48 | >gi|340361349|ref| ZP_08683778.1|/ 1-320 3-oxoacyl-[acyl-carrier-protein]synthase III [Neisseria macacae ATCC 33926] | MQYAKILGTGSYLPANRVSNDDLAKKVDTSDEWITTRTGIKFRHI ADEGEKTSDLAAEASRRALVAAGYTADEIDLIIVATATPDMQFPS TATIVQQKLGIANGCPAFDVQAVCAGFMYALSTANAYIKSGMA KKALVIGAETFSRIVDWNDRTTCVLFGDGAGAVVLGASDEAGII HSKLKADGNYLDLLNVPGQIANGQVCGSPYITMDGPGVFKFAVK MLAKIADEVISEAGYTPDQIDWLVPHQANKRIIDSTAKHLGLDME KVILTVQEHGNTSAASIPLALDVGIQNGQIKRGQNLLLEGIGGGF AWGAVLVKY |
| SEQ ID NO: 49 | >gi|344206308|ref| YP_004791449.1|/ 1-325 3-oxoacyl-ACP synthase [Stenotrophomonas maltophilia JV3] | MSKRIYSRIAGTGSYLPEKVLTNADLEKMVETSDEWIQSRTGIRE RHIAAEGETTSDLGYNAALRALEAAGIDASQLDMIVVGTTTPDLI FPSTACLIQAKLGVAGCPAFDVNAACSGFVFALGVADKFIRSGDC KHVLVIGTETLTRMVDWNDRTTCVLFGDGAGAVVLKADEETGI LSTHLHADGSKKELLWNPVGVSSGFKDGANGGGTINMKGNDVF KYAVKALDSVVDETLAANGLDKSDLDWLIPHQANLRHEATAKR LDMSMDQVVVTVDKHGNTSSGSVPLALDAAVRSGRVERGQLLL LEAFGGGFTWGSALLRY |
| SEQ ID NO: 50 | >gi|345304635|ref| YP_004826537.1|/ 1-346 3-oxoacyl-ACP synthase III [Rhodothermus marinus SG0.5JP17-172] | MPYAAITAVGHFLPEDRLTNADLEKMVDTSDEWIRTRTGIRERRI LRDPNKATSYMATEAARECLRKRGMDPEDVELIIVATVTPDMFF PATACLVQANLGARNAWGFDLSAACSGFLFALSTAARFIESGKH KRVMVIGADKMSTITDYTDRKNCILFGDAAAAVLLEPDPECGVI DSVEHCDGNNWELLCMLGGSLNPTHETVDRKMHYLHQEGR AVFKLAVEGMAQVAVEIMERNNLTADDVRYLVPHQANLRIIDA TARRMGLSPDKVMVNIDRYGNTTAATIPLCLYDWERQLRRGDN LILAAFGGGFTWGAIYLKWAYDGDKVAAAAEATAETSTENA |
| SEQ ID NO: 51 | >gi|349685677|ref| ZP_08896819.1|/ 1-323 3-oxoacyl-[acyl-carrier-protein]synthase III [Gluconacetobacter oboediens 174Bp2] | MTAKRSLLSGFGGYLPERIVTNDELASRLDTSDEWIRGRTGIGQR HIAGENDTAVSMAAQAARRALDYAGAAPDDVDAIIVATSTPDQ AFPSTAVRVQAELGMTSGFGFDLAAACSGFIYALSMADSLIRSGQ ARSALVIGSEVYSRILDWSDRGTCVLFGDGAGAAFLTAAGPDDG DAGILSTHLHSDGQYGDLLYVDGATGQHDRPAHLRMQGRDVFR HAVGKLSASVDEALAANNLSHADVNWLVPHQANLRIIDGVARK LALPAERVVVTVDRHANTSAASIPLALNEAVRDGRIRKGDLVLM EALGGGLTWGSALVRL |
| SEQ ID NO: 52 | >gi|352106212|ref| ZP_08961263.1|/ 1-373 3-oxoacyl- | MTHVVITGTGLYTPEHAIDNAALVAAFNAWVDGENEQHAEAIER GEREPLANSSSEFIEKASGIKSRYVLDASGILDPQRMRPKLPQRSN DEPSLQCEMATEAAHQALAAAQVDAADIELVIVACSNLERAYPA |

TABLE 1-continued

Synthase Sequences

| SEQ ID NO | FASTA Header | Protein sequence |
|---|---|---|
| | (acyl carrier protein) synthase III [Halomonas sp. HAL1] | VAVEVQQTLGTSGYGFDMNVACSSATFALETAANAIASGSVNRA LVVNPEICSAHLNFRDRDSHFIFGDACTAVVLENSAVAVADEQFE ILGTRLVTKFSNAIRNNAGFLNRVTDSDPMALDKLFVQEGRRVF KEVCPMVAKLITDHLASLELNGSDLKRMWLHQANRHMNDLIAR KVLGYDPSETQAPIILDRYANTSSAGSIIAFHLHREQFNQGDIGVIC SFGAGYSAGSVVIRRV |
| SEQ ID NO: 53 | >gi|358061230|ref| ZP_09147893.1|/ 1-313 3-oxoacyl- (acyl carrier protein) synthase III [Staphylococcus simiae CCM 7213] | MNVGIKGFGAYAPENIIDNAYFEQFLETESDEWISKMTGIKERHWA DEDQDTSDLAYNASVKAIEDAGIKPEDIDMIIVATATGDMPFPSV ANILQERLGTGKVASMDQLAACSGFMYSMITAKQYIQSGDYHNI LVVGADKLSKITDLTDRSTAVLFGDGAGAVIIGEVSEGRGIISYEM GSDGSGGKYLYLDKETGKLKMNGREVFKFAVRIMGDASTRVVE KANLTSDDIDLFIPHQANIRIMESARERLGISKDKMSVSVDKYGN TSAASIPLSINQELQNGKLKDDDTIVLVGFGGGLTWGAMTIKWG K |
| SEQ ID NO: 54 | >gi|373112342|ref| ZP_09526574.1|/ 1-328 3-oxoacyl- [acyl-carrier- protein]synthase 3 [Fusobacterium necrophorum subsp. funduliforme 1_1_365] | MKSVGIKGLSSYVPERIMTNFEFEKIIDTSDEWIRTRTGIEERRFAS PEQATSDLCYEATQKLLATMKMDPQEIDFIMVCTCTPDYPVPSTA CVLQSKLNLLGVPAVDINAACSGFMYGLAMATSMVQTGLYKNV LVIGAETLSRIMDMQDRNTCVLFGDGAGAAIIGEVEEGSGILATH LGAEGEDEGILQIPGGGSRYPSTLESVHTKKQFVQMKGQNVYKF AVHALPEATLAALKKAKVEASQVARFFPHQANLRIIEAAAKRMN VSLDKFHVNLHKVGNTSAASVGLALADALEKGMVKKGDYIALT GFGAGLTYGSVVMKWAY |
| SEQ ID NO: 55 | >gi|374851360|dbj| BAL54322.1|/1- 307 3-oxoacyl- [acyl-carrier- protein]synthase III [uncultured Aquificae bacterium] | MGTTLTGIGYYLPPKVLTNFDLEKMVDTSDDWITTRTGIKERRIA DNENVTQMAYMASLEALESANIQPEDIDLIILATLTPELKFPSTAC LLQAKLGAKRAYAFDISAACSGFIYGLELADAYIKSGKAKKILLV GAERLSEIVNWQDRSTCVLFGDGAGAVIISEGDGEVLSSKMLSDG ELWEILYAPKCGYINMKGKELFKLAVRSMEEVCRYVLESAGISIE DVSIMIPHQANIRIMEALAEKLGMPKEKVYSNIHKYGNTSAASIPI AMYEAYKEGKLRRGDIVMLTAMGGGLTWGAALLRF |
| SEQ ID NO: 56 | >gi|375098553|ref| ZP_09744816.1|/ 1-340 3-oxoacyl- (acyl-carrier- protein) synthase III [Saccharomonospora cyanea NA- 134] | MSTQDARGVAVLAGLGGWLPPRVVDNDELSRRLDTSDEWIRTR TGIAKRHVVHTGLSTVDMAVEAGRRALESAGPYGENVDAVVLA TSTPDHVCPASAPQVAAELGLSGAAAFDVNAVCSGFVYALATAS GLISGGVAKRVLLVGADAFTTLLDPDDRTTVPIFGDGAGAVVLR EGSADELGAVGPFDLHSDGELAELLIVPAGGSRRKKSENASDHFL KMQGPAVFRHATARMASSSRAVLEKAGWTTSDVDRFVGHQAN VRILTATAKNLGLPADSLVVNIGHTGNTSAASIPLAMVDAAVDG MLQPGDRVLVTAFGAGLTWGSTVLRWPELACAPLP |
| SEQ ID NO: 57 | >gi|381164912|ref| ZP_09874142.1|/ 1-326 3-oxoacyl- (acyl-carrier- protein) synthase III [Saccharomonospora azurea NA- 128] | MTRPTLTLAQGAKASRVLGVGSTQPDRVVTNDELSQHMDTSDQ WIRDRVGIIERRFAGEDERLVDMAVTAGAKALADAGVAPSEVDT VIVPNCTMPAPIPNAAAQVADRIGVKAAGAFDLNAACAGFCYGL GVASDLVRAGSAKKVLVIGAEKLTDVVDPTDRSTAIIFADGAGA ALVGPSDEPGIGPVAWGSAGDLVDVIYMRDNRYIFQEGQPVFRW ATTQIAPVAMRAVELAGLELSDIDVLIPHQANLRIVEAIAKRLRA KGARDDMVVADDIRYSGNTSSASIPMALDHMRAAGTVKPGDVV LTVGFGAGLSYAGQVLICP |
| SEQ ID NO: 58 | >gi|383771442|ref| YP_005450507.1|/ 1-326 3-oxoacyl- ACP synthase [Bradyrhizobium sp. S23321] | MTQIRSVVLGCGSYLPEQVVTNAQLAARIDTSDEWIVQRTGIRER HIAAEGEFTSHLAIKAAQAALTDAGLDAQSIDLIVLATSTPDNTFP ATAVAVQHGLGINHGAAFDLQAVCSGFVFALATADNFLRTGAF KRALVIGAETFSRILDWNDRGTCVLFGDGAGAVVLEAQEQPGNA ATDRGVVTTHLRSDGRHKAKLFVDGGPSSTQTVGHLRMEGREV FKHAVGMITDVIVDAFEATGLNADSIDWFVPHQANKRIIDASAH KLHIAPEKVVLTVDRHGNTSAASIPLALSVARRDGRIKRGDAVL MEAMGGGFTWGSALVRW |
| SEQ ID NO: 59 | >gi|384154990|ref| YP_005537805.1|/ 1-333 3-oxoacyl- ACP synthase [Arcobacter butzleri ED-1] | MIYAAFRSIGAYIPPKIMSNADFEKIIDTSDEWITKRTGIKERRIAN EGEASSDLGARAGELAIERAGISKEEIDLVICATVTPDFLCMPSTA CLIAAKLGLPNVMAFDVSAACTGFVYALNVAKAFIESGMKKNV LIVGAEKYSAILDYTDRTTCFLFGDGAGAAIISATNDKNESIIDINC SSDGNYEDLIKTPGGGSKNPCSQEVLENKMACIKMKGNETFKLA VKTLTSDVKTMLEKHNLTNEDINHFIPHQANYRIIKAVGEALDLS DEKTVVTVDKYGNTSAASIPMAMNYAFEQGKIKAGDTILFDAFG GGLTWGSALFKFAPIKR |

TABLE 1-continued

Synthase Sequences

| SEQ ID NO | FASTA Header | Protein sequence |
|---|---|---|
| SEQ ID NO: 60 | >gi\|384450582\|ref\|YP_005663182.1\|/1-335 3-oxoacyl-ACP synthase [Chlamydophila psittaci 6BC] | MCVKKTRKASIWATGSYLPEKILSNSDLEQMVDTSDEWIVTRTGI KERRIAAANEYTSIMGAKAAERAIQKAGLTKDQIECIIFSTSAPDY IFPSSAALAQAYLGIKDIPAFDCMAACTGYLYGLSVAKAYVESG MYNNVLLIAADKLSSFVNYKDRNTCVLFGDGGAACIIGESRPGA LEITNVNLGADGSVADLLSLPAGGSRVPASQETLEAGKHFISMEG KEVFKHAVRRMESAAKTCIAGAGIEESDIDWLVPHQANERIIDAI AKRFEIDEGKVFKTLCKYGNTAASSVCIALDELLQSHTIHSGEYL LLVAFGGGLSWGAVVLQQVES |
| SEQ ID NO: 61 | >gi\|385331603\|ref\|YP_005885554.1\|/1-373 3-oxoacyl-ACP synthase [Marinobacter adhaerens HP15] | MIKAVISGTGLYTPPATISNDELVEAFNQYVELFNAENADAIASG DVTPLQPSSSSFIEKASGIKRRHVIDKDGILDPNRMKPYIPDRSNEE PSVQCDMAVTACREALEQAGKSAEDVDAVIVACSNLQRAYPAV SIEVQEALGIDGFAYDMNVACSSATFGLQAAVNSVENGSARAVL VVSPEICSGHLNFRDRDSHFIFGDACTAILVEREEDTREGQGFEIL GTSLKTKFSNNIRNNFGFLNRADESGVGKPDKLFVQQGRKVFKE VSPLVAETIQKQLQSLSLAPDDLRRMWLHQANLNMNQLIARKVL GRDATEEEAPVILDEYANTSSAGSIIAFHKNKDDLVSGDLGVICSF GAGYSIGSVVVRRR |
| SEQ ID NO: 62 | >gi\|386265484\|ref\|YP_005828976.1\|/1-316 Beta-ketoacyl-ACP synthase III [Haemophilus influenzae R2846] | MNSRILSTGSYLPSHIRTNADLEKMVDTSDEWIVTRSGIRERRIAA ADETVATMGFEAAKNAIEAAQINPQDIELIIVATTSHSHAYPSAAC QVQGLLNIDDAISFDLAAACTGFVYALSVADQFIRAGKVKKALVI GSDLNSRKLDETDRSTVVLFGDGAGAVILEASEQEGIISTHLHAS ADKNNALVLAQPERGIEKSGYIEMQGNETFKLAVRELSNVVEET LSANNLDKKDLDWLVPHQANLRIITATAKKLEMDSQVVVTLD KYANNSAATVPVALDEAIRDGRIQRGQLLLLEAFGGGWTWGSA LVRF |
| SEQ ID NO: 63 | >gi\|386335197\|ref\|YP_006031367.1\|/1-373 3-oxoacyl-ACP synthase [Ralstonia solanacearum Po82] | MHDVVISGTGLWVAPEVITNEELVASFNAYARHYNEANATAIAA GTLAAVAESSVEFIEKASGIRQRYVIDKAGVLDPARMRPRLAPRG DDALSLQAEIGVAAAREALAAAGRDAGDIDMLICSAANMQRPYP AMGIEIQNALGADGYAFDMNVACSSATFGLEQAINAVRTGSARV ALMVNPEITSGHLAWKDRDCHFIFGDVCTAVVVERADDARAPD QWQVLGTRMATRFSNSIRNNAGFLSRSEDRDPDDRDQLFRQEGR KVFKEVCPMAAEHIAGHLQSLGHAPADVRRFWLHQANLGMNQ LIGKRLLGRDASADEAPVILDEFANTASAGSIIAFHRHRADLQPGD LGLICSFGAGYSIGSVAVRKR |
| SEQ ID NO: 64 | >gi\|390454110\|ref\|ZP_10239638.1\|/1-329 3-oxoacyl-(acyl-carrier-protein) synthase III [Paenibacillus peoriae KCTC 3763] | MNKLRPVGIIGTGKYVPEKILTNKDLEAIVETSDEWIVSRTGIQER HIAAPEQATSDLAYEAAIKALKSAGMTAEDLDLIIVATVTPDMAF PSTACILQDKLGAKGAAAFDLSAACSGFVYGLATATSFIKTGIYN NALIIGADCLSRITDYTDRNTCVLFGDGAGAVVIGEVSEGRGFQS FDLGAEGAGGSLLNLAAGGSRLPASADTLENKQHYIYMNGREVF KFAVRVMGTATVDVLEKAGLTKDDIDLFVPHQANIRIIQSAMQR LDLPEEKVVINVNKYANTSAASIPLALVEAAEEGRMKEGDRVLM VGFGGGLTWGASVLVW |
| SEQ ID NO: 65 | >gi\|392946737\|ref\|ZP_10312379.1\|/1-307 3-oxoacyl-(acyl-carrier-protein) synthase III [Frankia sp. QA3] | MLGLGVYRPARVVTNDEIAQRVETSDAWIQSRTGIATRRIADEEE TTVAMGAAAAEKALAAAGLTADTIDLVIGATCTSPSQIPGAGPQI AHRIGADQAGAFDINGACAGFSYAVSTAADMVRAGSVRHVLVV ATERLSDYTDWDDRSTCILLADGAGATVIGAAETDEIGPAVWGH DGSRPEAIRVPGYGDNMFRMEGQAVFRWAISLVPTVRQICERAG VAPDELAGIVPHQANLRIVEALATGIGATNAAVARDVVDSGNTS AASIPLGLARLLDAGEIRRGDPVLLFGFGAGLTYCGQVVRCP |
| SEQ ID NO: 66 | >gi\|397172008\|ref\|ZP_10495404.1\|/1-372 3-oxoacyl-(acyl carrier protein) synthase III [Alishewanella aestuarii B11] | MQQVVISGSGLFTPQHIISNDELVVSFNQYVDQFNTEHAAQIAAG ELAALEYSSSEFIEKASGIKARHVLYKDGILDPKVMHPVFRKRGE DELPEMVEMAVQAATQALAQANKTAADIDLIICAASNMQRPYP ALSVELQQALGAGGYAFDMNVACSSATFAISNAVNAIRGGSAKV VLVVNPEFASPQVDYRSRDSHFIFGDVCTATIIEAESSCTSSQAFRI LGMRLKTTFSNNIRCDIGYTEHCFSEQDPKAPFFKQQGRKVFKEL LPIVAEVILDEMAAQQVTADDLKRLWLHQANINMNIFAAKKILG RDPLPEEAPLVLDTYANTASAGSIIAFHKYQQGLQSGDKAILCSF GAGYSVGCLVLEKC |
| SEQ ID NO: 67 | >gi\|398305630\|ref\|ZP_10509216.1\|/1-312 3-oxoacyl-(acyl carrier protein) synthase III [Bacillus vallismortis DV1-F-3] | MKAGILGVGRYIPEKVLTNHDLEKMVETSDEWIRTRTGIEERRIA ADDVYSSHMAVAAAKKALEQAEVAAEDLDMILVATVTPDQSFP TVSCMIQEELGAKKACAMDISAACAGFMYGVVTGKQFIESGTYK HVLVVGVEKLSSITDWEDRNTAVLFGDGAGAAVVGPVSDDRGIL SFELGADGTGGQHLYLNEKGHTIMNGREVFKFAVRQMGESCVN VIEKAGLSKEDVDFLIPHQAMRIMEAARERLELPVEKMSKTVHK YGNTSAASIPISLVEELEAGKIKDGDVVVMVGFGGGLTWGAIAIR WGR |

TABLE 1-continued

Synthase Sequences

| SEQ ID NO | FASTA Header | Protein sequence |
|---|---|---|
| SEQ ID NO: 68 | >gi\|398884037\|ref\|<br>ZP_10638982.1\|/<br>1-373 3-oxoacyl-<br>(acyl-carrier-<br>protein) synthase<br>III [*Pseudomonas*<br>sp. GM60] | MHNVVISGTGLYTPANSISNEELVQSFNAYVAQFNADNADAIAR<br>GEVEALTESSAAFIEKASGIKSRFVMDKDGILDPQRMAPRLPERS<br>NDEWSVLCQMAIGAAEQALQRAGKTAADIDGVIVACSNLQRAY<br>PAIAIEVQEALGIQGFGFDMNVACSSATFGIQAAANSVQLGQARA<br>VLMVNPEVCTGHLNFRDRDSHFIFGDAATAVIIERADLATSKYQF<br>DVVSTKLLTKFSNNIRNNFGFLNRAAEEGIGAKDKLFVQEGRKVF<br>KEVCPMVAELIGAHLEENQLNVGDVKRFWLHQANLSMNHLIVR<br>KLLGREATEAEAPVILDTYANTSSAGSVIAFHKNQDDLAAGSLA<br>VLSSFGAGYSIGSVILRKR |
| SEQ ID NO: 69 | >gi\|399047091\|ref\|<br>ZP_10739223.1\|/<br>1-342 3-oxoacyl-<br>(acyl-carrier-<br>protein) synthase<br>III [*Brevibacillus*<br>sp. CF112] | MRQMDKKRSVGILATGSYTPDRVLSNFDLEKMVETTDEWIVSRT<br>GIRERRICSAEQASSDLAYEAAKKALERANISAEQLDMIIVATVTP<br>DMMFPSTACILQEKLGAKRAAALDVSAACTGFLYGITTAAQFIA<br>NGLYKYVLVVGVETLSKITNYKDRNTCVLFGDGAGAAVIGEVRE<br>GFGFQSFELGADGAGGELLCLPAGGSRIPASSESVENNLHYLSMA<br>GGEVFKFAVRVMNSATEAVLSKAGVERENIDLLVPHQANKRIID<br>SAVQRFGLSEDKVAINLDRYGNMSSASIPVALDEAIAAGRVKEG<br>DNVILVGFGGGLTWGATLLKWSTTPAEGSGQ |
| SEQ ID NO: 70 | >gi\|400755130\|ref\|<br>YP_006563498.1\|/<br>1-374 3-oxoacyl-<br>[acyl-carrier-<br>protein]synthase<br>3 [*Phaeobacter<br>gallaeciensis* 2.10] | MFTPAITGTGVFTPSQTITNAELVAAFNAYADKTNAENAKAIAAG<br>EMEPLAHSSEEFILKASGIEQRYVMDKSGVLDPEVMHPLLRQRG<br>DDEPSIMAEMALDAAKKALAQAGKTAADVDTVICAASNMERAY<br>PALAIEIQDLLGIKGFAFDMNVACSSATFGIQAAADMVRSGSIRS<br>ALVVNPEICSGHLEWRDRDCHFIFGDVATATLIERSEDATGAYFEI<br>LSTRCATSFSNNIRNNNGYLRRSRPDGVEDRRDMQFMQNGRKVF<br>KEVLPMVSQHIAEHMEAEGVSNTDLKRLWLHQANKTMNDFIGK<br>KVLGRTPEAGEQPNILQDYANTSSAGSIIAFSKYSDDLSAGDLGLI<br>CSFGAGYSVGSVILRRVA |
| SEQ ID NO: 71 | >gi\|400756529\|ref\|<br>NP_952652.2\|/1-<br>326 3-oxoacyl-<br>ACP synthase<br>[*Geobacter<br>sulfurreducens*<br>PCA] | MMRARIVGTGSAVPSKVLTNFDLEKMVDTSDEWVTTRTGIKERR<br>IAVDGEYTSTFATLAAERALEMAGVKASDLDLLIVATITPDFPFPA<br>TACVVQSNLKATKAAAYDISAACSGFIYALAQASNAIRSGSARK<br>ALVIGAEVLSRIIDWTDRNTCLLFGDGAGAVVLEACDDGHGVLS<br>THLHSDGSYWELLYQPGCGNRNPAVQKTLDDRRIYLMMQGNEV<br>FKLAVRAMEDAALEALDANGLTPADISLFIPHQANRRIIDAIGKRL<br>GLPGEKVYVNLDRFGNTSAASIPLALDEANRSGRIKPNDVVVFD<br>AFGGGLTWGSALVRW |
| SEQ ID NO: 72 | >gi\|401563713\|ref\|<br>ZP_10804658.1\|/<br>1-334 beta-<br>ketoacyl-acyl-<br>carrier-protein<br>synthase III<br>[*Selenomonas* sp.<br>FOBRC6] | MPKISAGILGTGYYVPERVLTNFDLEKMVQTNDAWIVERTGIHE<br>RRIAADGEPVSVLAQRAAEMALADAGVDAADLDLIIMATLTSDR<br>IIPSTACVLQDRLGAKHAAAFDLSAACSGFVYAASIAAQFIESGV<br>YRHVLVIGGETLSKVVDWEDRNTCILFGDGAGAAVFGPVEDGY<br>GIRAFDLGSDGSGGDALDIPSSGSLCPVTPETIEQRLNFVHMDGK<br>AVFRFATKVMGRTVETSLERAGMQREDLDYLVPHQANIRIIQAA<br>AKRLDMPMDKVIINIHRYGNMSAASIPVALAEAAHAQQFKKGD<br>NIALAGFGAGLTWASCIMKWAKEENG |
| SEQ ID NO: 73 | >gi\|402823152\|ref\|<br>ZP_10872590.1\|/<br>1-323 3-oxoacyl-<br>(acyl carrier<br>protein) synthase<br>III<br>[*Sphingomonas*<br>sp. LH128] | MIRSVLIGTGSALPRNAVSNAELAERVDTSDEWIVERTGISNRHIA<br>EADETTSSLATEAGRKAIEAAGIDAESIDLIVLATATPDQTFPASA<br>TIVQSRLGCRAGGIAFDVAAVCSGFLYAVGVADSMLRTGMARR<br>ALVIGAETFSRILDWEDRTTCVLFGDGAGAVVLEAQEQVGETPR<br>GILATRLHADGAHNQLLFVDGGPSTTGTVGKLRMKGREVFRHA<br>VVNLAEVLREVIEEAGLSTSDIDWLVPHQANARILDATAKKLSLP<br>PEKVVMTVGQHANTSAASVPLALDVAVRDGRIKQGDLVMLEA<br>MGGGFTWGASLIRI |
| SEQ ID NO: 74 | >gi\|407684813\|ref\|<br>YP_006799987.1\|/<br>1-374 3-oxoacyl-<br>ACP synthase<br>[*Alteromonas<br>macleodii* str.<br>'English Channel<br>673'] | MSQQVVISGVGVWHPKDSITNEELVDSYNAYVDAFNEENKAQIE<br>SGDVAAMPYSSAEFIEKASGIKSRYIYQKEGALDITRMKPKIAPR<br>ADDELSHQAEIAVEAAKLALASANVTADEIDAVIVSCAYTQRAY<br>PAIAIEVQEALNIEGFGFDMLVACSAATFGMHRAYEMLSAKNAT<br>RVLVINPELVSPQINYADRDSHFIFGDVATATVLELAETAKSEHV<br>YDVLSTKALTKFSNNIRSNFGYMTRAEDVDPYGPDKLFHQAGK<br>VFKEVCPLAAAHIEAHLASHDITPEGVKRWWLHQANINMNTLIC<br>KRLLGRDADRTEAPIVLDEYANTASAGSVIAFGLNHEDLVAGDV<br>GVLCSFGAGYSIGSLVIRKR |
| SEQ ID NO: 75 | >gi\|410479651\|ref\|<br>YP_006767288.1\|/<br>1-341 3-oxoacyl-<br>(acyl-carrier-<br>protein) synthase<br>III<br>[*Leptospirillum<br>ferriphilum* ML-<br>04] | MTPTMLNRSIILGTGSFAPANVLTNEDISRKVETSDLWIRERTGIR<br>ERRIASSGESTSDLALEAGRNALRNAALSPADLDGIIVATATPDLT<br>FPSTACLVQRARLGIPGTFAFDVNAVCSGFMYALKIADSMIRSGQC<br>ETLLVIGAEVMSRFVDWSDRSTCILFGDGAGAVVLGKSGSPQTG<br>GVGTVTLHADGRYWDLIHVPGGGSRSPVETEKPPGNACTIRMKG<br>SETFRMAVRSLEESVREVLKEEGIGVNELDWVVPHQAMRILEAL<br>SERLGIPLGHFVVNIDRYGNTSAASIPMALDEAVQDKRIQPGHRIL<br>LTAFGSGVTWGSLVHWTQKAGGDR |

TABLE 1-continued

Synthase Sequences

| SEQ ID NO | FASTA Header | Protein sequence |
|---|---|---|
| SEQ ID NO: 76 | >gi\|410617776\|ref\|ZP_11328741.1\|/1-319 3-oxoacyl-[acyl-carrier-protein]synthase 3 protein 1 [Glaciecola polaris LMG 21857] | MNSRIIGTGSYYPSEVRTNADLSLMVDTSDEWITDRTGIKERRIIG ADETAASMGVEASKKALEAAGIDAKSLDMIVCATTSGRYALPST ACEIQKALDIDGIPAFDVAAACAGYCYALSVADQYIKSGMAKRIL VVGTDCLSRMISPEDRTMVILFGDAAGATIIEASEEPGILSTHIHAA GSYGDLLAIGNPTRGDEASIHENWGSMKGNEVFRVAVTKLSEVV EETLAANNMQKSDLDWLVPHQANFRIIKATAKKLNMSLDQVVL TLERYGNTSAATVPTALDEAIRDGRIKRGQNLLLEAFGGGFAWA SALVRY |
| SEQ ID NO: 77 | >gi\|411009303\|ref\|ZP_11385632.1\|/1-319 3-oxoacyl-(acyl carrier protein) synthase III [Aeromonas aquariorum AAK1] | MHSKILGTGSYLPHSVRTNADLEQMVETSDEWIVERTGIRERRIA GADETVATLSHQAALRALEAAGLTAADLDMIVLATTSAENAFPA AACELQGLLGVQGIPAFDVAAACAGFTYALSIADQFVKSGAARH VLVVGADVLSRMCDPEDRGTIILFGDGAGAVVIGASDTPGILSTH LHADGRYGELLKLPQPRRGMPGAELEAYMYMKGNDVFKVAVT RLSEIVTETLAAAGIEPSELDWLVPHQANFRIISATAKKLGMGLD KVVLTLDKHGNTSAASVPIAFDEGVRDGRIKPGQLVLLEAFGGG FAWGSALVRL |
| SEQ ID NO: 78 | >gi\|415794657\|ref\|ZP_11496472.1\|/1-316 3-oxoacyl-(acyl-carrier-protein) synthase III family protein, partial [Escherichia coli E128010] | YTKIIGTGSYLPEQVRTNADLEKMVDTSDEWIVTRTGIRERHIAA PNETVSTMGFEAATRAIEMAGIEKDQIGLIVVATTSATHAFPSAA CQIQSMLGIKGCPAFDVAAACAGFTYALSVADQYVKSGAVKYA LVVGSDVLARTCDPTDRGTIIIFGDGAGAAVLAASEEPGIISTHLH ADGSYGELLTLPNADRVNPENSIHLTMAGNEVFKVAVTELAHIV DETLAANNLDRSQLDWLVPHQANLRIISATAKKLGMSMDNVVV TLDRHGNTSAASVPCALDEAVRDGRIKPGQLVLLEAFGGGFTWG SALVRF |
| SEQ ID NO: 79 | >gi\|417318270\|ref\|ZP_12104859.1\|/1-287 3-oxoacyl-(acyl carrier protein) synthase III [Listeria monocytogenes J1-220] | MDTSDEWIRTRTGIEERRIARDDEYTHDLAYEAAKVAIKNAGLTP DDIDLFIVATVTQEATFPSVANIIQDRLGAKNAAGMDVEAACAGF TFGVVTAAQFIKTGAYKNIVVVGADKLSKITNWDDRTTAVLFGD GAGAVVMGPVSDDHGLLSFDLGSDGSGGKYLNLDENKKIYMNG REVFRFAVRQMGEASLRVLERAGLEKEDLDLLIPHQAMRIMEAS RERLNLPEEKLMKTVHKYGNTSSSSIALALVDAVEEGRIKDNDN VLLVGFGGGLTWGALIIRWGK |
| SEQ ID NO: 80 | >gi\|417334430\|ref\|ZP_12117640.1\|/1-221 3-oxo acyl-acyl-carrier-protein synthase KAS3 [Salmonella enterica subsp. enterica serovar Alachua str. R6-377] | MLGIKGCPAFDVAAACAGFTYALSIADQYVKSGAVKHALVVGS DVLARTCDPGDRGTIIIFGDGAGAAVLSASEEPGIISTHLHADGRY GELLTLPNADRVNPDNPIYLTMAGNEVFKVAVTELAHIVDETLQ ANNLDRSELDWLVPHQANLRIISATAKKLGMSMDNVVVTLDRH GNTSAASVPCALDEAVRDGRIKAGQLVLLEAFGGGFTWGSALIR F |
| SEQ ID NO: 81 | >gi\|417747984\|ref\|ZP_12396438.1\|/1-335 3-oxo acyl-(acyl-carrier-protein) synthase III [Mycobacterium avium subsp. paratuberculosis S397] | MKQIAATSGPTNIGLLSVGSYRPQRVVTNDELCQNIDSSDEWIYS RTGIKTRRFAARDESTASMATEAGREAIAKAGLEASDIDCVVAT STHFLQTPACGPAVAAALGATGVPAFDISAGCAGFGYALGVAAD MVRGGTAGKVLVLGSEKLSPTVDMTDRSNCFIFADGAAGVVVG ETPTQGIGPTVWGSDGTQATAIRQDIDWMDYLDRPTGPRPFLRLE GSAVFRWAAFEMGKVGQQAMDAAGVRPDEIDVFLPHQANSRIN EILAKSLELRPDAVIANDIEHTGNTSAASIPLAMAEVLATGAAKA GDLALLIGYGAGLSYAAQVVRLPPG |
| SEQ ID NO: 82 | >gi\|420680190\|ref\|ZP_15164698.1\|/1-220 3-oxo acyl-[acyl-carrier-protein]synthase 3 [Yersinia pestis PY-47] | MLGIKDAASFDLAAACAGFTYALSVADQYVKSGAVKHAIVIGSD VLSRALDPEDRGTIILFGDGAGAVVLGASEQPGIMSTHLHADGRY GELLALPYPDRQQDQPAYVTMAGNEVFKVAVTELAHIVDETLQ ANNLDRTALDWLVPHQANLRIISATAKKLGMGMDKVVITLDRH GNTSAASVPSAFDEAVRDGRIQRGQLVLLEAFGGGFTWGSALVR F |
| SEQ ID NO: 83 | >gi\|421612789\|ref\|ZP_16053888.1\|/1-392 3-oxo acyl-(acyl-carrier-protein) synthase III | MIETSSNVTANDLAAKSVNEESSAESTAVPTEAVSAVMPGNATT RGRMGNLKGVRIAGTGSYVPERIVTNEDLAALGCDSDWIVRRTG ILQRRHAEPGQATSDLCYEAALRCLENANVSVDEIDLILVATITPD HPTPSTACHLQRRLGAVAPAMDIGAACAGFMYALVTGAQFVSN GNARNVLVIGADLMSRTVDPEDKKTYPLFGDAAGAALLVPSTQ DECQSTECNGSAADSTSQTDGLLAYQLGSEGCGGEMLCIPAGGS |

TABLE 1-continued

Synthase Sequences

| SEQ ID NO | FASTA Header | Protein sequence |
|---|---|---|
| | [Rhodopirellula baltica SH28] | RTPITTDGEDSASRYLQMDGRGVFKWAVRVFDESAKDVLRAAN VSSDQLSLVVLHQANQRIIDSAVSDLNVPPEKVFVNLDKYGNTSG ASIPLALDEAARAGRLKEGDLVLLCGFGAGLAWGTALLRW |
| SEQ ID NO: 84 | >gi\|421888767\|ref\| ZP_16319848.1\|/ 1-355 3-oxo acyl-(acyl-carrier-protein) synthase III (Beta-ketoacyl-ACP synthase III) (KASIII) [Ralstonia solanacearum K60-1] | MPRCRFPPPLRPPTPHKGSAPGHPIPTPHMTRYARIIGTGSYLPPK RVTNHELAAQLAEKGIETSDEWIVTRSGIRARHYAEPDVTCSDLA VKAAERAIEAAGIDRAEIDMILVATSTPDFVFPSAACLVQQKLGL SNHCAAFDLQAVCSGFVYALATADKFIRAGGCRNVLVIGAEVFS RILDFNDRTTCVLFGDGAGAVVLQASDEPGILSTALHADGSHADI LCVPGNVAAGAIKGSAFLYMDGQAVFKLAVNVLDKVAREALGL ANVEASQIDWLIPHQANIRIMQGTAKKLGLPNERMVVTVDEHGN TSAASIPLALDAAVRDGRIRKGHHVLLEGVGGGFTWGAALLRF |
| SEQ ID NO: 85 | >gi\|422338672\|ref\| ZP_16419632.1\|/ 1-328 3-oxoacyl-(acyl-carrier-protein) synthase III [Fusobacterium nucleatum subsp. polymorphum F0401] | MQSIGIKGIGYYVPENVFTNFDFEKIIDTSDEWIRTRTGIVERRFAS KDQATSDLAREAALKAIENAKIKKEDVDMIILATTTPDYIAQGAA CIVQNKLGLTSIPCFDLNAACTGFIYGLEVAYSLVKSGLYKNVLVI GAETLSRIIDMQNRNTCVLFGDGAAAAIVGQVEEGYGFLGLSIGA EGEDDMILKVPAGGSKKPNDEETIKNRENFVIMKGQDVFKFAVS TLPKVTLDALEKAKLDVNDLSMVFPHQANLRIIESAAKRMKFPL EKFYMNLSRYGNTSSASVGIALGEAVEKGLVKKGDNIALTGFGG GLTYGSAIIKWAY |
| SEQ ID NO: 86 | >gi\|423074933\|ref\| ZP_17063653.1\|/ 1-331 3-oxoacyl-(acyl carrier protein) synthase III [Desulfitobacterium hafniense DP7] | MVSVGIVGTGSYVPDKVLTNFDLEQMVDTNDQWIVSRTGIKERH IAEPETPVSELCYQAAVRALEDAKLPPEELDLVIVATITPDFVFPA TACLVAERLGAKKAAGFDLQAACTGFLYGVATAAQFIATGIYKN ALVIGGETLSKILNWEDRGTCILFGDGAGAAVLQPVEEGYGFLG YDLGMDGAGGSLLTMPGGGSMHPASAETVAKKMHTIQMAGSE VFKFAVRIMGETALKALDKAGLGIGDVDCLIPHQANTRIVDAAV KRLGIDAKKVVVNLDRYGNMSAASIPVALDEAARSGRLNYGDI MVMVGFGGGLTWGAAVVKWSKRGV |
| SEQ ID NO: 87 | >gi\|423197564\|ref\| ZP_17184147.1\|/ 1-373 hypothetical protein HMPREF1171_ 02179 [Aeromonas hydrophila SSU] | MTSIVISGSGLYTPPFAVSNEALVAAFNQYVDLYNEENASAIDAG QLPAKQHSSSEFIEKASGIKSRYLVSKEGVLDPDIMQPLLAERPDD KPSIMVEMAVAAAEQALIAAGREPGEIDLVIVAASNMPRPYPALS IELQHYLGASGMAFDMNVACSSATFGIKTAADMLAAGSARLAL VVNPEICSGHLNFRDRDSHFIFGDACTAVLLEREADCQVANPWQ LVASKLVTQYSNNIRNNFGFLNRLSPRTRYGDDKLFRQQGRIVKF KEVLPLVCDQIAGQLDEQGWAADSLSRLWLHQANLTMNQFIAR KLLGHDASQQEAPVILDSYGNTSSAGSIIAFHLYNRDLPAGARGV LCSFGAGYSIGSLLLRRL |
| SEQ ID NO: 88 | >gi\|424068956\|ref\| ZP_17806404 .1\|/ 1-373 3-oxoacyl-ACP synthase [Pseudomonas syringae pv. avellanae str. ISPaVe013] | MHNVVISGTGLFTPANSISNEELVQSFNAYVAQFNSDNAAAIERG DVQALSESSAAFIEKASGIKSRFVMDKEGILDPQRMKPNLPERSN DEWSILCEMGVAAATQALQRAGKTAADIDGVIVACSNLQRAYP AISIEIQQALGVAGYGFDMNVACSSATFGIQAACNSVQLGQARAL LVISPEICTAHLNFRDRDSHFIFGDGATAVVVERADLATSPYQFDI VSTRLLTQFSNNIRNNFGFLNRTSDEGQSAPDKLFVQEGRKVFRE VCPMVAELVAAHLQDNGINITDVKRFWLHQANLSMNHLIVKKL LGRDASVEEAPVILDTYGNTSSAGSVIAFHTYQDDLPQGALAVLS SFGAGYSIGSVILRKR |
| SEQ ID NO: 89 | >gi\|424853848\|ref\| ZP_18278206.1\|/ 1-339 3-oxoacyl-[acyl-carrier-protein]synthase [Rhodococcus opacus PD630] | MGKQIATVAGGRQSALLGLGVYRPERVVTNDEICELIDSNDEWI QSRSGIRNRRFAAEDENVVTMSIAAGRKAIEASGIDPEQIGCVIVA TSTYLLLTPPAAAVVADALGTNGPGAFDLGGCAGFCTALTVAS DLVRGGSVDYALVVGVEKMSITTDPTDRSTRFIFGDGAGAVVVG KSDVAGIGPVEWGSDGAQADAIVQDLDWYEYITTPGATRPYIKM AGTAVFRWAAFEMGKVALRAVEKAGMSVDDLDAFVPHQANSR ITEVIARSMKLPENVPVSDDIAESGNTSAASVPLAMEEMLQSGAT KPGDTALLLAFGAGLSYAAQVVTMPVLAKD |
| SEQ ID NO: 90 | >gi\|427825838\|ref\| ZP_18992900.1\|/ 1-329 3-oxoacyl-[acyl-carrier-protein]synthase III [Bordetella bronchiseptica Bbr77] | MMEKAMKYAKIAGSGGYLPERVVTNDDLAAELATRQISTSDEW IVERTGIRQRHLAERGVTTSQLPRGPGAFDLGGCAGFVYAMT VATSTPDYVFPSTACLVQANLGAKGGAAFDVQAVCSGFVYAMT TADSFIRAGRARCALVIGAEVFSRILDWNDRGTCVLFGDGAGAV VLKAADEPGILAAHLHADGSQTKILCAAGNVAYGDVTGDPFLR MDGQAVFKQAVTVLDRSARDVCAEAGVEVDDIDWLIPHQANVR ILNFLARKLRVPTERVVITVDQHANTSAASVPLALDVARRDGRV KPGQLVLMQGVGGGFTWGSVLARM |
| SEQ ID NO: 91 | >gi\|441509582\|ref\| ZP_20991498.1\|/ | MSVIAANTGHQNVAMLGIGAYRPQRLVSNDEVCEVLDSSDEWIF ERSGVRNRRWISGDESARSMAAAAAERAIENSGIAKEKIGALILA |

TABLE 1-continued

Synthase Sequences

| SEQ ID NO | FASTA Header | Protein sequence |
|---|---|---|
| | 1-356 3-oxoacyl-[acyl-carrier-protein]synthase III [*Gordonia aichiensis* NBRC 108223] | TNSWKTKIPHGGPIVAYDIGLNGIPAYDIAAGCGGFGYALGVAA DTVRAGSAEYVLVVGVETMSVVMEPTDRNTAFIFGDGAGAVVV GPSEANGISPTVWGSDGENAEAIGQNYDIPEYMDRAQEYQHKDP ETDPVGRMVVTMQGPRVFRWAAITLPKALTSVIERSGISADDIEV FVPHQANARINELMKKNLGFPDDMPMANDIENTGNTSAASIPLA MEEMLATGKAKGGQTALLLGFGAGLSYAGAVVTLPPAPKVSSF DDLG |
| SEQ ID NO: 92 | >gi\|443293257\|ref\| ZP_21032351.1\|/ 1-314 3-oxoacyl-(acyl-carrier-protein) synthase III; acetylCoA ACP transacylase [*Micromonospora lupini* str. Lupac 08] | MTGSRIVSMGHYQPSRVVTNDDIAKLVDTNDEWIRDRVGIVSRRI ADGETVADMAAAAAGKALANSGLSASDIDLVVVATCSSIDRSPN VACRVAAKLGIAAPGAFDVNTACSGFAYALGTVDHAVRAGASR NALVIGAEKLSDFTDWTDRSTCIIFGDGAGAAVVTATADDEPAGI GPVVWGSVPEKSDAVRIEGWRPYIQQEGQSVFRWATTAIAPLAL QACERAGVDPSELAAFVPHQANARIIDGIAKRLNIPDAIIAKDIVE SGNTSAASVPLALSKLVERREVPSGAPVLLFGFGGGLTYAGQVV RCP |
| SEQ ID NO: 93 | >gi\|443491493\|ref\| YP_007369640.1\|/ 1-362 3-oxoacyl-[acyl-carrier-protein]synthase III, FabH_1 [*Mycobacterium liflandii* 128FXT] | MEHRPECCCGCALAQMPSPPEESVPLPPTVGILGTAAFVPPRVVT NNQAGASAGIDDAWIFARTGIRTRRWADPEQATSDLAVQAAEQ ALANTAINAGQLGAIIVSTSTPDQPQPPTAAFVQNALHANSAYAF DTNAVCSGFLFAINTAHALAQRDSIHVLVIGADVYSRILDPTDRK TVCLFGDGAGAVVVGPTTASSRHLRIVDTELHTFTQHINLIGVPG GGSRQPLTTATLDAGQHYFHMDGRGVRDFVTTTVPEQVRKFLA RHHLAVEDIDHVVMHQANGRMLDEIYSLLDLRNATCHQTIDRFG NTGSASIPITLHHAYPELHGNILCIGFGGGMAAGITLLAAASGSAG DVGAHK |
| SEQ ID NO: 94 | >gi\|444307652\|ref\| ZP_21143377.1\|/ 1-353 3-oxoacyl-(acyl carrier protein) synthase III [*Arthrobacter* sp. SJCon] | MSVPTLKQAPIQEHTRILGLGAYRPDVIVTNEDVCQWIDSSDEWI RQRTGIVTRHRAKADVSVIDMAEGAAREAMEKAGIEASELGAVI VSTVTHPYATPSAAASLADRLGATPAPAFDISAACAGYCYGIAQ GDALVRSGTAKYVLVVGAEKLSDVIDNRERTISFLLGDGAGAVV IGPSETPGIAPSVWGSDGSKWDAIGMTRSMLDVRDLGLAARQSD STGDLALLEEAQELYPTLRQDGQTVFRWAVWEMAKVAQQALE AAGVEAEDLVAFIPHQANMRIIDEMVKKLKLPETVTVARDIADA GNTSAASIPLATHRLLQENPELSGGLALQIGFGAGLVFGAQVVVL P |
| SEQ ID NO: 95 | >gi\|459055350\|ref\| ZP_23152864.1\|/ 1-338 3-oxoacyl-[acyl-carrier-protein]synthase III [*Gordonia paraffinivorans* NBRC 108238] | MAVIADTTGIKNIGMLGIGAYRPERVVTNEEICQHIDSSDEWIYTR TGIKTRRFARRDESVMEMAVNAGRKAIANALLHGSDIDAVILAT NTHLLLTPAGATKVATELGANGVPAFDVTVGCAGFGYGMALAS DMIRGGSATHVLVIGAEQLSVTLDMTDRTNCFIFGDGAGAVVVG PTEEQELGPVVWGSDGSQFNAIRQDLDWVTFLDSDRKQRPYLRL EGTAVFRWAAFEMGKVAHRALEAAKIGAEDLDVFVPHQANARI NELLARSLKLREDAVVANDIEYTGNTSAASIPLAMEDLLSTGKAQ PGQTALLLGFGAGLSYASQVVKLPPVPFE |
| SEQ ID NO: 96 | >gi\|474659331\|emb\| CCV14840.1\|/1-373 Beta-ketoacyl-acyl-carrier-protein synthase I [*Mesorhizobium* sp. STM 4661] | MHRVIISGLGVEIPEPSITNEELVASFNAWVDTENVRRQASGEAPL AKSDSAFIVHASGVQTRHVIEREGILDPTRMAPRIPARPDDALSLQ AEFGIASARKALDHAGLKPSDIDLVICSSSHQQRPYPAIAIEMQEA LGTKGAGFDMGLGCSSAAAALHMAVNLVRSGAHKRVLVTTPEII TGHLNFRDRQTHFIFGDASVSMIVEGLAKGDKRPGRFEVLDTRIW TQMSNNIRTNLGYHTRTAQDDPYMINLEGNLIKQVGNKVFKEVT VAGHKFIVEFLAEHGLTPEAIRRFWLHQANARMNAMILKLSFGH EVGHDRAPMVLERLGNTAGAGAIIALSENHADMKPGDFGLLCAF GAGYSIGGALLRML |
| SEQ ID NO: 97 | >gi\|478769383\|gb\| ENO13968.1\|/1-322 3-oxoacyl-ACP synthase [*Marinobacter nanhaiticus* D15-8W] | MPYARIIGTGSYLPEKALTNKDMEKMVDTTDQWIRERTGIERRHI AAEGETTVDLAEQASLKAIEAAGIDVQDIDLIVFATSTPDKIFPSC ACILQARLGIQGCPAFDIQAVCSGFVYALSTADKFIKTGASKKAL VIGSEVFSRIVNWEDRGTCVLFGDGAGAVVLEANEETGILSTHIH ADGQYEDLLHVPCGISDDFERVKAGQAFIEMKGNEVFKVAVNTL GKIVDETLEYNQMQKSDIDWLVPHQANLRHAATAKKLNMSMD QVVVTVNEHGNTSAASIPLALDVAVRDGRIKRNEVLLLEAFGGG FTWGSALLRY |
| SEQ ID NO: 98 | >gi\|479875377\|gb\| ENU26638.1\|/1-368 hypothetical protein F992_02187 [*Acinetobacter* sp. NIPH 236] | MGIRITGTGLFHPTESISNEELVESLNAYVEQFNQENAEQIAAGEI EALRGSSPEFIEKASGIQRRYVVEKSGILDPKRLPRLQERSNDEL SLQAEWGVIAAKQAMENAGVTAEDIDVVILACSNMQRAYPAVA IEIQSALGIQQGYAYDMNVACSAATFGLKQAYDAVKCGARRVLLL NVEITSGHLDYRTRDAHFIFGDVATASIIEETETKSGYEILDIHLFT QFSNNIRNNFGFLNRSEDAVVDDKLFRQDGRKVFPKEVCPLVAKII TAQLEKLELTPEQVKRFWLHQANANMNELILKLVVGKEADLER APIILDEFANTSSAGVIIAMHRTGEQVNNGEYAVISSFGAGYSVGS IIVQKHIA |

TABLE 1-continued

Synthase Sequences

| SEQ ID NO | FASTA Header | Protein sequence |
|---|---|---|
| SEQ ID NO: 99 | >gi\|345301988\|ref\|YP_004823890.1\|/ 3-oxoacyl-ACP synthase III [Rhodothermus marinus SG0.5JP17-172] | MLPEQSLTTPLPATTTAAPARRAAVLGVGAALPAHREPSAETERR LGLPPGWIARRTGIRERPLVGPDEATSDLAVRAGAAALAQAELSP ERIGLLLLATSTPDHLLPPTAPVVAHRLGLKHAGAIDLAGACSGF LYALALADGYVRLQRTCVLVIGANVLSRRTNPDDPKTSALFADG AGAVVLGPSEGSRGIVACWLGADGSCWDDLYIPAGGSRRPLTPE RVARGEHLMYMKDGRALFRRAATGMAEAGRRVLQQAGLDLDD VAWWIPHQANLRLIEEARRQLGMPEARTVNLVDRIGNSSAATIPL ALALEAHRFAPGDLLLLTAVGAGLLSAAVLIQW |
| SEQ ID NO: 100 | >gi\|471324089\|ref\|YP_007523119.1\|/ 3-oxoacyl-[acyl-carrier-protein] synthase 3 protein 3 [Streptomyces davawensis JCM | MTAPTAVLAGLGSALPPRVVTNHDLTARMDTSDEWIRTRTGIAE RRIVDPGGATSDLAIEAGRRALDSAGGPDVGAVVATATPDHPC PATGPTVAAGLGLGTVPAFDVGAVCSGFLYALATGAGLIAASVA DSVLVVGADAFTTIVDPYDRNTAPIFADGAGAVVLRAGRADEPG ALRRTELASDGMQADLIRVAAGGSRQRSHHSAALREDQYLTMR GGEVFKNAVLRMTEASRTVLDRTGWSTAEVDLLVGHQANVRIL HAVAEQLGIGQERAYVNIGHTGNTAAASIPLALDDAHGEGRLRA GDKVLLTAFGAGTTWGAITLTWPEGLQYRGAAGSAAA |
| SEQ ID NO: 101 | >gi\|330444499\|ref\|YP_004377485.1\|/ 3-oxoacyl-ACP synthase III [Chlamydophila pecorum E58] | MDKIKKAAILATGSYLPEKILSNADLEKMVDTSDEWIVTRTGIKE RRIASDNEYTSDMGAKAAEKAlRASGLSKDLIDCIVFATSAPDYIF PSSGALAQAYLGIKEVPAFDCLAACTGFLYGLSIAKAYVESGTYN HVLLIAADKLSSFVNYQDRNTCVLFGDGGAACIVGRSRPGALEIN QVCLGADGALGDLLSLPAGGSRNPATEATLKEGRHYISMEGKEV FKHAVRRMEAASKASIAVAGIQEEQVGWLVPHQANERIIDAIAK RFNISEAKVFKSLYKYGNTAASSLGIALDELLNTETVLPHEYLLLT AFGGGLSWGSVVLEHV |
| SEQ ID NO: 102 | >gi\|459068159\|ref\|ZP_23165498.1\|/ 3-oxoacyl-(acyl-carrier-protein) synthase III [Clostridium ultunense Esp] | MNSLYSVGITGIGSYVPEKVITNYDLCEIVDTSNEWIVERTGIQER RIVDQSLSTSDIGTIAANKALEDSNTNPKEIDLIIVATATPDMAFPS TACIVQKNIQAINAAAFDISAGCSGFIYGLSIGFNFIKAGTYRKVL VIGGETLSKIVNWEDRNTCVLFGDGAGACILERCEEGFGFLTFDL GSDGNNGHLLIQPAGGSRLPASYETVSNRLHTIKMDGREVFKFA VRIIEKSSKEVLRKANIPLEQIDLLIPHQANMRIIQSAIKKLQLEEN KVYINLDKYGNMSSASIPVALDEAYKKEFFSKGDIVLLVAFGAGL TWGATLLRWNK |
| SEQ ID NO: 103 | >gi\|383454618\|ref\|YP_005368607.1\|/ 3-oxoacyl-(acyl-carrier-protein) synthase III [Corallococcus coralloides DSM 2259] | MARTHIIGTGSYAPTQVLTNQDLERLVETSDAWIRERTGIQERRQ AAPDEATSDLAVNAARNALEMAGVAPGDLDLIVVGTVTADMP MPSCAALVQSKLGAKRAFAFDVSAACAGGLYALSVADQFVRSG QVKRALVVGADLLTRAVDWTDRNTCVLFGDGAGALVLGAEQD ADEDAMAPRGILSTHLRTDGDLANLLCIPAGGSRTPVTADNVDA NLHKLKMNGKEVFRFAVRALVESTQASLGAHGMDTTQVDHVIA HQANLRILEAVMERLEIPKEKCWLNLHKYGNTSSASLPMSLDEA QRAGRLKRGDVIAMMAIGAGMAWGSAVVRW |
| SEQ ID NO: 104 | >gi\|333371191\|ref\|ZP_08463153.1\|/ 3-oxoacyl-[acyl-carrier-protein] synthase III [Desmospora sp. 8437] | MRIMGSVGIIGTGAYLPEKVLTNADLEKMVDTNDEWIVSRTGIRE RRIAADDQASSDLAVEAGRRALESAGIEAKDLDLIIVATVTPDMA FPATACLVQDRLGAEKAATFDLSAACTGFLYGISVASQFISNGMY RHALVIGVDCLSKITDFTDRNTCVLFGDGAGAAVLGPVEEGKGF LSFELGGDGSGGHLLKQPAGGSRIPASGKSVEDRLHFISMNGREV FKFAVRVLGSSAEEALRKAGMTKEDVDFLIPHQANTRIIDTAVQR LGLSRDKVVVNLDRYGNMSSASIPVALDEAVQRGKIKKDDTLVL VGFGGGMTWGASVMKWTMETK |
| SEQ ID NO: 105 | >gi\|390454110\|ref\|ZP_10239638.1\|/ 3-oxoacyl-(acyl-carrier-protein) synthase III [Paenibacillus peoriae KCTC 3763] | MNKLRPVGIIGTGKYVPEKILTNKDLEAIVETSDEWIVSRTGIQER HIAAPEQATSDLAYEAAIKALKSAGMTAEDLDLIIVATVTPDMAF PSTACILQDKLGAKGAAAFDLSAACSGFVYGLATATSFIKTGIYN NALIIGADCLSRITDYTDRNTCVLFGDGAGAVVIGEVSEGRGFQS FDLGAEGAGGSLLNLAAGGSRLPASADTLENKQHYIYMNGREVF KFAVRVMGTATVDVLEKAGLTKDDIDLFVPHQANIRIIQSAMQR LDLPEEKVVINVNKYANTSAASIPLALVEAAEEGRMKEGDRVLM VGFGGGLTWGASVLVW |
| SEQ ID NO: 106 | >gi\|392959403\|ref\|ZP_10324886.1\|/ 3-oxoacyl-(acyl-carrier-protein) synthase 3 [Pelosinus fermentans DSM 17108] | MNKKCVGIIGLGSYVPQRIMTNKDLEERMDTSDQWIVERTGIHE RRVAAENESTSDLAAKAGQKALEDAKISPAEIDLIIVATASPDMV FPATACVVQENIKAVNAAAFDISAVCSGFLYAMITGSQFIKAGTY RKVLVIGAETLSRFTDWSDRNTGMLFGDGAGAAVLGETPEGYGI LGVDLGADGGGAELLKIPAGGSRHPATMETILQKQHFIYMNGNE VFKFAVKVMGETTLKALKNANLTASDITYLVPHQANIRIIQSAAK RLGIPMEKVVVNINKYGNTSAASIPIALDEAVKSGAIKSGDIVALA GFGGGLTWASSIMKWCK |
| SEQ ID NO: 107 | >gi\|116626090\|ref\|YP_828246.113-oxoacyl-ACP | MPKAKISALGCYTPPRVLTNQDLEKLVDTNDQWIMERTGIRERHI AAPEMATSDMAIEEARCALLQRGIDACEIDAIILCTVTPDHLFPST ACLVQNAIGAKGAWGFDLIAACSGFLYGLTTGAHFVMAGTHKK |

TABLE 1-continued

Synthase Sequences

| SEQ ID NO | FASTA Header | Protein sequence |
|---|---|---|
| | synthase [*Candidatus Solibacter usitatus* Ellin6076] | VLVIGSDTMSRIIDYTDRATCVLFGDGAGAMLIEATDEADDGTGF IDFLGEIDGSGGEFLRMPAGGSRRPASHETVDQRMHYVHQEGSQ VFKYASRKMYEVCRDLLERNHFKVEDVGLMIPHQANKRIIKAAG DRLGIAPERVMINIERYGNTTAGTLPLATRDAISEGRLKKGDLVL FAAVGAGYTVGASLWRWAF |
| SEQ ID NO: 108 | >gi\|323702691\|ref\| ZP_08114352.1\|/ 3-oxoacyl-(acyl- carrier-protein) synthase III [*Desulfotomaculum nigrificans* DSM 574] | MSSNLVQAGIIGVGSYVPERILTNKDLEKMVDTSDEWITSRTGIK ERRIADPEESTSELAVKAARRALAHAGVKPEELDLIILATCTKDM PFPASACLVQDQLGAVNAGAFDIEAGCTGFVYALTVGSQFVATG SMKRVLVIGADNLSKVTNWEDRNTCVLFGDGAGAVVLGPVAPG EGILASKLAAEGAGWKYLSMPAGGSRMPASPLTVEKKLHYIHM QGREVFRYAVKVMEEEAANIVKAAGLALSDIDLLIPHQANIRIIEH AAKKLKLSMDKVVVNVDRYGNTSTASIPLALDEAVKSGRVKAG DNIVMVAFGAGLTSGAIVLKWSLGEGKE |
| SEQ ID NO: 109 | >gi\|384566084\|ref\| ZP_10013188.1\|/ 3-oxoacyl-(cyl- carrier-protein) synthase III [*Saccharomonospora glauca* K62] | MSTGILGAAGYLPPRVIDNDQVGAWVDRDPDWILERTGIKERHY AAPEVSTSDMACLAVEKLYASCPEKRASVGAVILGTSTPDHNFPS TAAIVQGRMGLGRAFAFDLSAACSGYLFSFVTAHSLLSANPALEE VLVIGADTISKVLYQSDRKTVTVFGDGAAATRVGRVPDGYGLLT HTLITDGCHADYVGQPAGGSRRPLDATTVNARERYMVMHGRKV REYFEEVVPKLIHEVVEQAGVSLDDIDHFVFHQANPQMLADCIN AMGIDPAKCPVPGVLSGNTGAASIPLVLSELRAERGDLVVMAAI GSGMTAGAAVLRWY |
| SEQ ID NO: 110 | >gi\|298162138\|gb\| ADI59524.1\| CorB [*Corallococcus corralloides*] | MNQGGVFPLPFKIAGLGRYVPADVVLSSDLEKKYDLPPGWCVE KQGIRERRWVKDETASFMGAEAAKEAVRDAGLKLEDIDLIINAS GSPEQAVPDGGPLVQRELGLGRSGVPSITVNASCLSFFVALDVAA NYLNMRRYKRILIVSSDISSVALDFRKPENFTLFGDAAAAAVVTL PEPGEKSCIHASQVRTYGYGAEFSMVPGGGSRRHPNGKNTTPED NYLHMNGAELLKIGFEYLPRFNEALWKQCPDITIKDCRYVIPHQP SRVVLDYLSLTYPDDKLVRIIDRFANCIGASMPMALYEAVKVGG LRRGERGVLTGTGSGVSFVGMVFTY |
| SEQ ID NO: 111 | >gi\|148359775\|ref\| YP_001250982.1\|/ 3-oxoacyl-(acyl carrier protein) synthase III FabH [*Legionella pneumophila* str. Corby] | MNFFRCEKPIYIKGPFVALPERVMSNQDVLNWMNSTQNPAVIGF STGIKNRHWVNEDQACSDLAVRAAEHLFMEKPREKHKVNQVIL ATISGDYPSPPSSPLVQYRLGLQNAGAFDIGAACAGFVVGLHTSA ALAQTNDGSVLLIASEIRSKFLNKNNFATSVLFGDGAAACCVSQD KEEADFRFIASALFADGEVYDAVSTPAGGSRLPAAVCNDNEQFYI TIKESTALFVKAVHGMADSAKDFLKELNLTISDIQWLVPHQGNK NLVLSVAKQLGFPEEKTIKTVEETGNTSGSSVGIALDRLRSDGKIK SGEKVLLVAAGGGGIAACSLLEVI |
| SEQ ID NO: 112 | >gi\|15824218\|dbj\| BAB69376.1\|3- oxoacyl-(acyl carrier protein) synthase [*Streptomyces ayermitilis*] | MTNEHLARRLDTDDAWIRTRTGIRRRHAVDPGQATSDLAVEAG RRALVCAATASVDAVVVATTTPDHSCPATAPAVAARLGLTGAA AFDISAVCTGFVYGLASAAGLIAAGVAERVLLIGADTYSTIVDPL DRANAIIFGDGAGAVVLRAGHPDEPGAVGHFDLGSDGAHEDLIM VAAGGSRQRSRPGEPSRQDRHFGMRGKEVYRHAVTRMAESARA TLSRAGWKTDDVDHFVPHQANLRILHSVADDLGLPRERCVTHVE SVGNTGAASIPLALADAAAGQTLRPGDRVLLTAFGGGLTWGSCL LTWPTLPAPAPPYDPHAQGERTTS |
| SEQ ID NO: 113 | >gi\|330468931\|ref\| YP_004406674.1\|/ 3-oxoacyl-(acyl carrier protein) synthase III [*Verrucosispora maris* AB-18-032] | MALSSHVEYESTTRTAVIAGLGAYVPDQVVKNEEIAARLGVTTD WIRDRTGIEQRFVLNPEGATSDLAVEAARRALDSCGNPDIDFLIL ATCTPDHLFPSTAPSVASRLGFKGIAAFDLNAACSGFVYALSVST GMLATGAYRTGLVIGADAISSILNHDDEITGPIFGDGGGAVVVRA GHLGETGSVSVQQLGSDGDLLDIMKTPGGGSRQRAAGVPVDIDS SYFTMSGRAVYKHAINRMSTVSRSVLERLGWTPDDVDWLIAHQ ANRRILTATAEEIGIAPERAVINVDRVANTSAASIPLAMVDAVESG ALTAGDKVLLAAFGGGATWAAAGLTWPELTLAPTQTVR |
| SEQ ID NO: 114 | >gi\|32444698\|emb\| CAD74700.1\|3- oxoacyl-(acyl- carrier protein) synthase [*Rhodopirellula baltica* SH 1] | MIETSSNVTANDLAAKSVNEESSAESTAVPTEAVSAVMPGNATT RGRMGNLKGVRIAGTGSYVPERIVTNEDLAALGCDSDWIVRRTG ILQRRHAEPGQATSDLCYEAALRCLENANVSVDEIDLILVATTPD HPTPSTACHLQRRLGAVAPAMDIGAACAGFMYALVTGAQFVSN GNARNVLVIGADLMSRTVDPEDKKTYPLFGDAAGAALLVPSTQ DECQSTECNGSAADSTIQTDGLLAYQLGSEGCGGEMLCIPAGGSR TPITTDGEDSASRYLQMDGRGVFKWAVRVFDESAKDVLRAANV SSDQLSLVVLHQANQRIIDSAVSDLNVPPEKVFVNLDKYGNTSGA SIPLALDEAARAGRLKEGDLVLLCGFGAGLAWGTALFRW |
| SEQ ID NO: 115 | >gi\|392374495\|ref\| YP_003206328.1\|/ 3-oxoacyl-[acyl- carrier-protein] synthase III (Beta- ketoacyl-ACP | MYGSRIAGTGASVPDRVLTNAELEQMVSTSDEWIVTRTGISERRI ASDDQATSDLAEGAARQALEASGVDPHDLDLILVNTVTPDMFFP STACVLQERLGASRAAAFDLMAACAGFVYGLSVADAYLRAGV MRNILVIGADTLSKVVDWSDRGTCVLFGDGAGAVVVQRTTADP AILSTHLYSDGSKGRQLIIPGGGSRQPASQKVIDEKLVTIRMPNGN EVFKTAVRSMEEAAIAALKANGAEVSDVDLFISHQANARIIYAVA |

TABLE 1-continued

Synthase Sequences

| SEQ ID NO | FASTA Header | Protein sequence |
|---|---|---|
| | synthase III)(KAS III)[*Candidatus Methylomirabilis oxyfera*]] | ERLDLPRERIYMNIDRYGNTSAASIPIAMDEAVRAGRLKRGDLLL LTAFGGGFTWGSALIRW |
| SEQ ID NO: 116 | >gi\|317121784\|ref\| YP_004101787.1\|/ 3-oxoacyl-(acyl-carrier-protein) synthase III [*Thermaerobacter marianensis* DSM 12885] | MVAAVRGVTIAGIGGCVPPAVVTNDDLAQVVETDDEWIRTRTGI RQRRVADPGTATSDLAEVAARRALEEAGVRPDQVDLIIVATVTP DMPFPSTACLLQDRLGATRAAGFDLEAACSGFVYALAAGAQFIA AGLYDTVLVVGAETLSKIIDWSDRRTCVLLGDGAGAAVLRPAAP GEGILGLYLGADGSGGDLLKQPAGGSRLPASPETVARGLHFVQM NGREVFKFAVKTMGDAAQAALAQAGLTFDDVDLYVPHQANFRI IESSARRFDLPLERVVVNIDRYGNTSAASIPVALDEALSTGRIRAG QTVLLVAFGGGLTWGAAVVRWGYDRPAPRPLEMPGQEPRYGLP EWIREQAARGRARAGEPAQGEPAAAASEATAPAALAVPRAALD PAAVTAASPGSEGRPAWGGGGTR |
| SEQ ID NO: 117 | >gi\|383787841\|ref\| YP_005472409.1\|/ 3-oxoacyl-ACP synthase [*Caldisericum exile* AZM16c01] | MKVGVLGLGSYIPEKVVTNHDLEKFLDTSDEWIRTRTGIVERRIA NENEATSDLASIAAKRALEDANLKPEDIDLIIVGTNSPDMLYPAT ACLVQEKIGASGKCAAFDLQAGCPGFIYATVVGSQFVKSGAYKH VLVIGAEVITRMMDPTDRGTYVLFGDGAGAVVLGEVEDNRGIV DFELYADGSIAEHLTLPAGGSRKPFSEEVLKERSYFTKMNGGEVF KFSVREISRISKKLLDKTGTKLEDIDWFIPHQANLRIIQAGAEKLGI PMEKVVVTIDKFGNSSAASIPVSLDTIRKEGKLKRGDLVLMVSFG AGMTSGAILMRW |
| SEQ ID NO: 118 | >gi\|404450648\|ref\| ZP_11015628.1\|/ 3-oxoacyl-(acyl carrier protein) synthase III [*Indibacter alkaliphilus* LW1] | MKKTRAVITGVQGWVPEYVLTNRELETMVDTNDEWITTRTGIKE RRILKGENQGTSVIGINAVKGLLEKTNTKAEDIDLIICATVTPDMP FPATANHADGVGAKNSYSYDISAACSGFLYALTIGSQFIETGMHK KVIIVGADKMSSIIDYQDRATCHFGDGGGAVLLEPTQEKVGIMDS LLHADGSGAPFLHMKAGGSRKPASLETIAAREHFAFQEGSTVFKF AVTNMAEVSARIMERNNLASEDIAWLVPHQANKRIIDATANRM GVGPDKVMLNIEKYGNTTAGTLPLCLWDYESQLKKGDNIILAAF GGGFTWGSIYLKWGYDPK |
| SEQ ID NO: 119 | >gi\|189502112\|ref\| YP_001957829.1\|/ 3-oxoacyl-(acyl carrier protein) synthase III [*Candidatus Amoebophilus asiaticus* 5a2] | MRTAIRASITGVHGYVPEYILTNEKLEKMVDTNDEWITTRTGIKE RRILEGTNQGTSVLGIPAVRGLLEKTNTDPREIDLLICATITPDMIT PATANIIAHAVGATNAFSYDLQAACSGFLYALITGVQFIETGKYK KVVVVGADKMSSIVNYEDRNSCILFGDGAGAVLLEPNSQGYGII DSILKGDGNGEQYLHQKAGGSRRPPSAETIAAKEHYVYQEGRAV YRFAVEKMAEVVLEIMKKNNLHHEDIKFLVPHQANKRILDAVA QRAGIKEEQVMITIQEFGNTTGATIPLCLWRYESQLQPGDKLIITT FGGGGFTWGAAYLTWAYK |
| SEQ ID NO: 120 | >gi\|395801183\|ref\| ZP_10480443.1\|/ 3-oxoacyl-ACP synthase [*Flavobacterium* sp. F52] | MSAVITAIGGYVPSSILTNKKISETVDTSEEWIIKRTGIRERRIADD DTATSDLAAAAIENLIENYNVDREEIEALLVATATPDHILAPTASI VCDKSGLTNAFGIDMNAACSGFLYALEMGANMIESGRYKKLIIV GADKMSSIVDYEDRNTCILFGDGAGAILLEKSESDAGLMKTILKT DGSGVSSLAVPAGGSRNPTSMQSLLHRTHYLKQDGAFVFKRAV AAMSQVSQDALAKNELEADQIDWVVPHQANLRIITAVGESLGID FEKVKVNIDRYGNTTSATVPLCLWDFKDDFKEGQNVLITTFGAG FSWGATCLKWGVMRERKSAETITATTKAEAVLVEH |

(2) Phase One (Reaction Initiation)—Ketoacyl-CoA Reductase, 3-Hydroxyacyl-CoA Dehydratase and Enoyl-CoA Reductase As noted above, the reaction initiation phase for even chain fatty acid products is completed by the conversion of 3-ketobutyryl-CoA to butyryl-CoA by three enzymes: a ketoacyl-CoA reductase, a hydroxyacyl-CoA dehydratase, and an enoyl-CoA reductase. For this phase, the ketoacyl-CoA reductase may be selected from the group consisting of 3-ketobutyryl-CoA reductase (e.g., fadB, a bifunctional enzyme—SEQ ID NO 183) and 3-hydroxybutyryl-CoA dehydrogenase (e.g., hbd—SEQ ID NO 271); the hydroxyacyl-CoA dehydratase may be selected from the group consisting of 3-hydroxybutyryl-CoA dehydratase (e.g., fadB, a bifunctional enzyme—SEQ ID NO 183) and enoyl-CoA hydratase (e.g., crt—SEQ ID NO 272); and the enoyl-CoA reductase may be trans-2-enoyl-reductase (e.g., ter—SEQ ID NO 275). Preferably, the bifunctional fadB is both the ketoacyl-CoA reductase and the hydroxyacyl-CoA dehydratase, or the ketoacyl-CoA reductase is hbd and the hydroxyacyl-CoA dehydratase is crt.

As noted above, the reaction initiation phase for odd chain fatty acid products is completed by the conversion of 3-ketovaleryl-CoA to valeryl-CoA by three enzymes: a ketoacyl-CoA reductase, a hydroxyacyl-CoA dehydratase, and an enoyl-CoA reductase. For this phase, the ketoacyl-CoA reductase may be selected from the group consisting of 3-ketovaleryl-CoA reductase (e.g., fadB, a bifunctional enzyme—SEQ ID NO 183) and 3-hydroxyvaleryl-CoA dehydrogenase (e.g., hbd—SEQ ID NO 271); the hydroxyacyl-CoA dehydratase may be selected from the group consisting of 3-hydroxyvaleryl-CoA dehydratase (e.g., fadB, a bifunctional enzyme—SEQ ID NO 183) and enoyl-CoA hydratase (e.g., crt—SEQ ID NO 272); and the enoyl-CoA reductase may be trans-2-enoyl-reductase (e.g., ter—SEQ ID NO 275). Preferably, the bifunctional fadB is both the ketoacyl-CoA reductase and the hydroxyacyl-CoA dehydratase, or the ketoacyl-CoA reductase is hbd and the hydroxyacyl-CoA dehydratase is crt.

(3) Phase One (Reaction Initiation)—Malonyl-ACP Pathway

Figure 12:
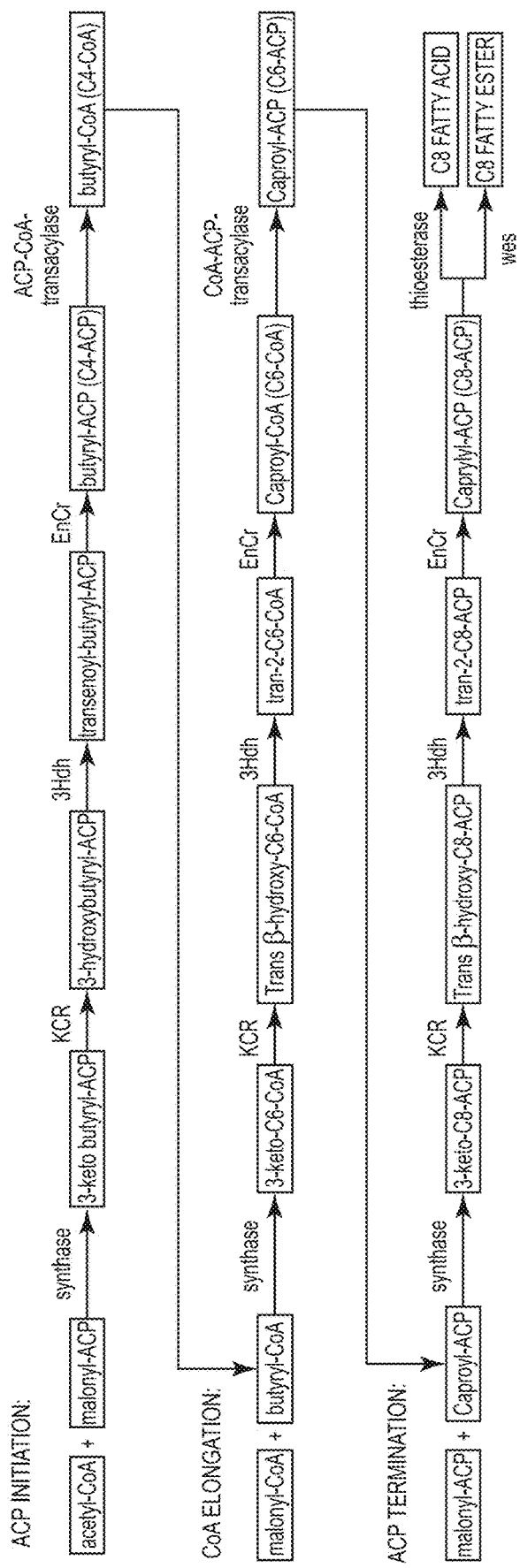
Figure 13:
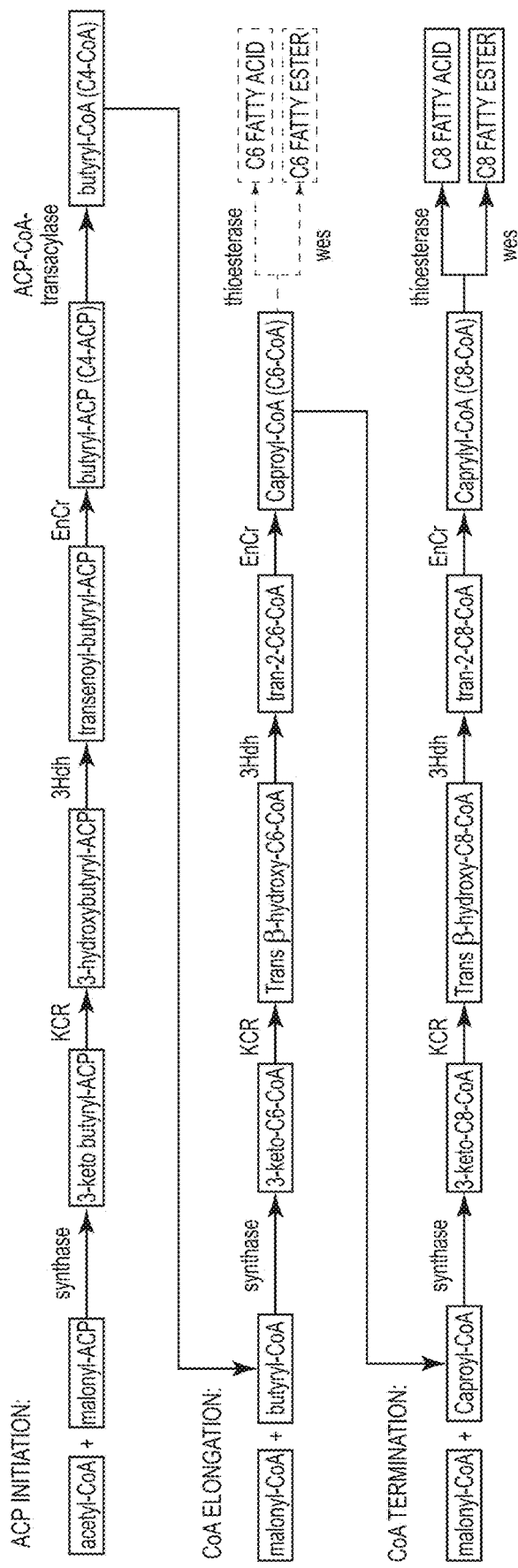
Figure 14:
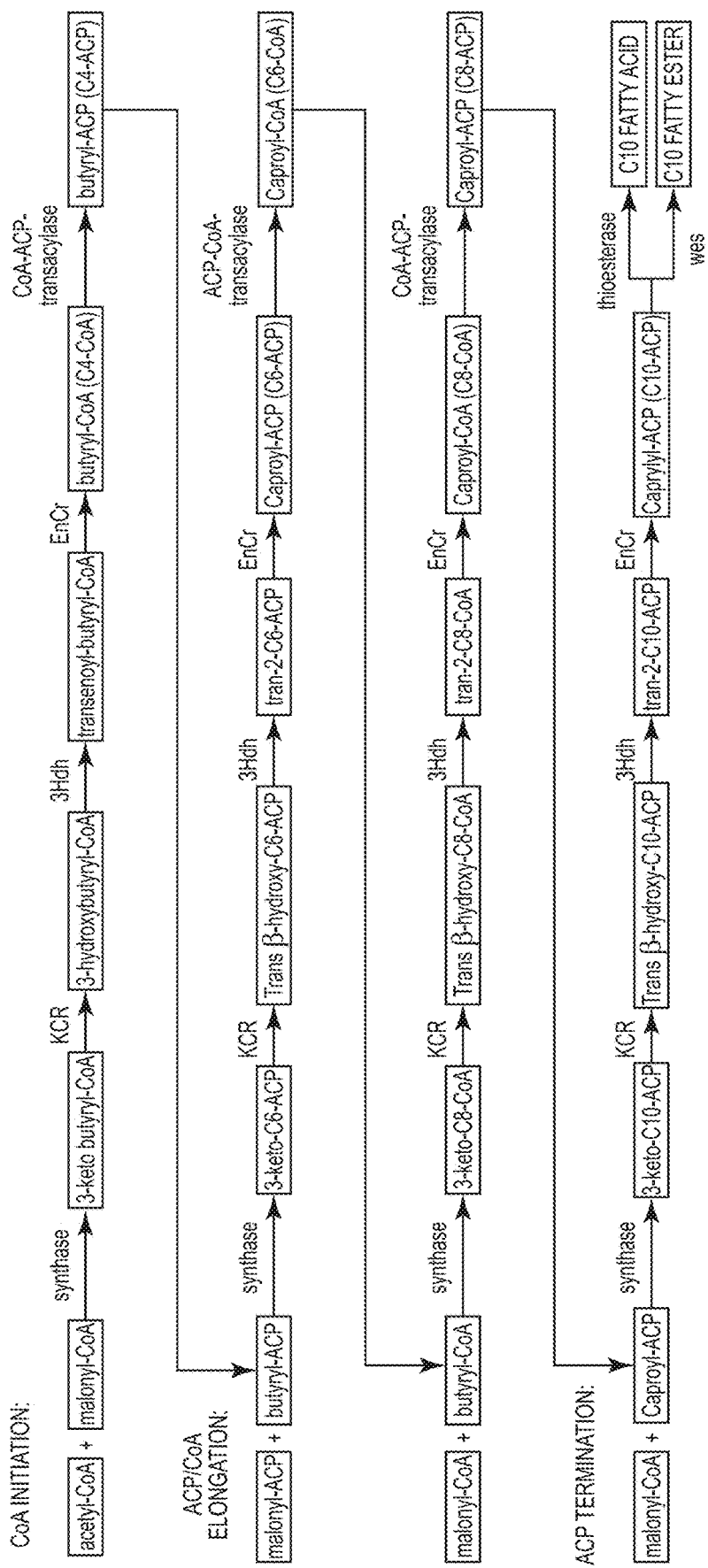

In accordance with an alternative embodiment, as shown in FIG. 12 and FIG. 13, the initiation phase may be achieved through a malonyl-ACP dependent pathway with at least a portion of one or more subsequent phases (i.e., elongation phase and/or termination phase) relying upon the malonyl-CoA dependent pathway. In accordance with this embodiment, the reaction to produce even chain fatty acid products is initiated through conversion of acetyl-CoA+malonyl-ACP to 3-ketobutyryl-ACP. In accordance with this embodiment, the reaction to produce even chain fatty acid products is initiated through conversion of propionyl-CoA+malonyl-ACP to 3-ketovaleryl-ACP. In accordance with this embodiment, a genetically modified microorganism is provided having encoded therein one or more enzymes described herein that catalyze reactions along the malonyl-CoA dependent pathway, and wherein native enzymes facilitate the initiation phase through the native malonyl-ACP pathway.

(4) Phase One—CoA/ACP or ACP/CoA Transition to Elongation

If a CoA-dependent elongation phase immediately follows an ACP-dependent initiation phase (see for example FIG. 13), the microorganism must also encode for a transacylase, such as butyryl-ACP:CoA transacylase, which will convert butyryl-ACP to butyryl-CoA or valeryl-ACP: CoA transacylase, which will convert valeryl-ACP to valeryl-CoA. Similarly, if an ACP-dependent elongation phase immediately follows an CoA-dependent initiation phase (see for example FIG. 11), the microorganism must also encode for a transacylase, such as butyryl-CoA:ACP transacylase, which will convert butyryl-CoA to butyryl-ACP or valeryl-CoA:ACP transacylase, which will convert valeryl-CoA to valeryl-ACP. Suitable butyryl-CoA:ACP transacylase include fabH, preferably from *E. Coli*, FASN, preferably from *Homo sapiens*, and FAS1, preferably from *Saccharomyces cerevisiae*. Additional transacylases include enzymes of the class 2.3.1.38, such as from *Brassica juncea*, *Euglena gracilis*, and ACT from *Streptomyces collinus*.

Alternatively, a genetically modified microorganism may be encoded for a gene that transitions a fatty acid production pathway from an ACP-dependent pathway to a CoA-dependent pathway, or conversely from a CoA-dependent pathway to an ACP-dependent pathway, by converting any ACP intermediate to its corresponding CoA intermediate, or vice versa. For example, the genetically modified microorganism may be encoded for phaG, preferably from *Pseudomonas putida* KT2440, which converts 3-hydroxyacyl-ACP to 3-hydroxyacyl-CoA.

B. Genetic Modifications to Drive Phase Two—Chain Length Extensions (Elongation)

The second phase of the malonyl-CoA dependent pathway involves a cyclic process wherein the length of the carbon chain is extended by two carbons with each cycle. As illustrated in FIG. 7, this phase requires a ketoacyl-CoA synthase, a ketoacyl-CoA reductase, a hydroxyacyl-CoA dehydratase, and an enoyl-CoA reductase. Accordingly, a genetically modified microorganism of the present invention includes native or exogenous enzymes encoded therein that provide these functions.

(1) Phase Two (Elongation)—Ketoacyl-CoA Synthase

NphT7 exhibits significant specificity for acetyl-CoA and propionyl-CoA as primers in the initiation phase, and it shows minimal activity with larger acyl-CoA chains during the elongation phase. Most 3-ketoacyl-CoA synthases that are capable of catalyzing the condensation of longer acyl-CoA chains are found in plants, mammals, yeast and other lower eukaryotes. Without a 3-ketoacyl-CoA synthase that has specificity for longer acyl-CoA, there will be no elongation of the acyl-CoA chain greater than $C_4$-CoA or $C_5$-CoA, and therefore 3-ketoacyl-CoA synthases that have specificity for longer acyl-CoA may be required.

In one aspect, the present invention provides a modified NphT7 polypeptide that functions as the ketoacyl-CoA synthase during the elongation phase in the malonyl-CoA dependent pathway. The modified NphT7 comprises an amino acid sequence having at least 70% but less than 100% or about 100% homology to SEQ ID NO:1 and one or more amino acid substitutions, deletions, or insertions, wherein the modified NphT7 polypeptide is capable of accepting an acyl-CoA substrate having a carbon chain length of C4 or greater, for example C5, C6, C7, C8, C9, C10, C11, C12, C13, C14, C15, C16, C17, C18, C19, C20, C21 or C22. In some embodiments, the modified NphT7 polypeptide is capable of catalyzing a condensation reaction to condense an acyl-CoA substrate with a malonyl-CoA to produce a 3-ketoacyl-CoA having a carbon chain length of C6 or greater, for example C7, C8, C9, C10, C11, C12, C13, C14, C15, C16, C17, C18, C19, C20, C21 or C22. In some embodiments, the modified NphT7 polypeptide comprises one or more amino acid substitutions selected from the group consisting of I147T, F217V, Y144L, V157F, G309S, G288S, a PDRP to HFLQ substitution for amino acids 86-89, I147F, I147M, I147Q, 1147S, I147C, 1147E, I147N, I147W, I147D, I147R, I147P, I147L, V196G, I147G, I147H, I147K, I147V, I147A, I147Y, F217G, F217A, F217L, F217I, F217M, F217T, F217P, F217S, F217E, F217L, F217W, and any combination thereof. In some embodiments, the modified NphT7 polypeptide comprises one amino acid substitution selected from the group consisting of I147V, I147F, I147M, I147Q, I147S, I147C, 1147E, I147N, I147W, I147D, I147R, I147P, I147L, I147G, I147H, I147K, I147A, I147Y, and F217V. In some embodiments, the modified NphT7 polypeptide comprises two amino acid substitutions selected from the group consisting of I147T and F217V, I147T and Y144L, I147T and V196G, I147F and F217V, I147M and F217V, I147S and F217V, I147T and HFLQ, I147T and V157F, I147T and F217G, I147T and F217A, I147T and F217L, I147T and F217I, I147T and F217M, I147T and F217P, I147T and F217S, I147T and F217E, I147S and F217G, I147S and F217A, I147S and F217L, I147S and F217I, I147S and F217M, I147S and F217W, I147S and F217S, I147S and F217E, I147S and F217K, I147F and F217A, I147F and F217L, I147F and F217I, I147F and F217M, I147F and F217P, I147F and F217E, I147M and F217G, I147M and F217A, I147M and F217L, I147M and F217I, I147M and F217M, I147M and F217P, I147M and F217S, I147M and F217E, and I147M and F217K. In some embodiments, the modified NphT7 polypeptide of any embodiment, comprising three amino acid substitutions selected from the group consisting of (Y144L, I147T, and F217V), (I147T, F217V, and HFLQ), (I147T, V147F, and F217V), and (Y144L, I147T, and V157F). In some embodiments, the modified NphT7 polypeptide comprises one or more amino acid substitutions at a position selected from the group consisting of Ser84, Val114, Gly288, Ile194, Gly318, Thr85, Gln90, Val196, Tyr144, Phe159, Ile147, Phe217, and any combination thereof. In some embodiments, the modified NphT7 polypeptide comprises an I147T amino acid substitution. In some embodiments, the modified NphT7 polypeptide comprises an F217V amino acid substitution. In some embodiments, the modified NphT7 polypeptide comprises two or more amino acid substitutions, deletions, or insertions, such as an I147T amino acid substitution and an F217V amino acid substitution. In some embodiments, the modified polypeptide is isolated and purified.

In one aspect, the present invention provides an isolated and purified polynucleotide encoding a modified NphT7 polypeptide. In some embodiments, the isolated and purified polynucleotide comprises a nucleic acid sequence having at least 70% but less than 100% or about 100% homology or complementarity to SEQ ID NO:2, wherein the polynucleotide encodes a modified NphT7 polypeptide of SEQ ID NO:1 having one or more amino acid substitutions, deletions, or insertions, wherein the modified NphT7 polypeptide is capable of accepting an acyl-CoA substrate having a carbon chain length of C4 or greater, for example C5, C6, C7, C8, C9, C10, C11, C12, C13, C14, C15, C16, C17, C18, C19, C20, C21 or C22. In some embodiments, the isolated and purified polynucleotide encodes a modified NphT7 polypeptide capable of catalyzing a condensation reaction to condense an acyl-CoA substrate with a malonyl-CoA to produce a 3-ketoacyl-CoA having a carbon chain length of C6 or greater, for example C7, C8, C9, C10, C11, C12, C13, C14, C15, C16, C17, C18, C19, C20, C21 or C22. The isolated and purified polynucleotide of any embodiment that encodes a modified NphT7 polypeptide comprising one or more amino acid substitutions selected from the group consisting of I147T, F217V, Y144L, V157F, G309S, G288S, a PDRP to HFLQ substitution for amino acids 86-89, I147F, I147M, I147Q, I147S, I147C, I147E, I147N, I147W, I147D, I147R, I147P, I147L, V196G, I147G, I147H, I147K, I147V, I147A, I147Y, F217G, F217A, F217L, F217I, F217M, F217T, F217P, F217S, F217E, F217L, F217W, and any combination thereof. In some embodiments, the isolated and purified polynucleotide encodes a modified NphT7 polypeptide comprising one amino acid substitution selected from the group consisting of I147V, I147F, I147M, I147Q, I147S, I147C, I147E, I147N, I147W, I147D, I147R, I147P, I147L, I147G, I147H, I147K, I147A, I147Y, and F217V. In some embodiments, the isolated and purified polynucleotide encodes a modified NphT7 polypeptide comprising two amino acid substitutions selected from the group consisting of I147T and F217V, I147T and Y144L, I147T and V196G, I147F and F217V, I147M and F217V, I147S and F217V, I147T and HFLQ, I147T and V157F, I147T and F217G, I147T and F217A, I147T and F217L, I147T and F217I, I147T and F217M, I147T and F217P, I147T and F217S, I147T and F217E, I147S and F217G, I147S and F217A, I147S and F217L, I147S and F217I, I147S and F217M, I147S and F217W, I147S and F217S, I147S and F217E, I147S and F217K, I147F and F217A, I147F and F217L, I147F and F217I, I147F and F217M, I147F and F217P, I147F and F217E, I147M and F217G, I147M and F217A, I147M and F217L, I147M and F217I, I147M and F217M, I147M and F217P, I147M and F217S, I147M and F217E, and I147M and F217K. In some embodiments, the isolated and purified polynucleotide herein encodes a modified NphT7 polypeptide comprising three amino acid substitutions selected from the group consisting of (Y144L, I147T, and F217V), (I147T, F217V, and HFLQ), (I147T, V147F, and F217V), and (Y144L, I147T, and V157F). In some embodiments, the isolated and purified polynucleotide herein encodes a modified NphT7 polypeptide comprising one or more amino acid substitutions at a position selected from the group consisting of Ser84, Val114, Gly288, Ile194, Gly318, Thr85, Gln90, Val196, Tyr144, Phe159, Ile147, Phe217, and any combination thereof. In some embodiments, the isolated and purified polynucleotide herein encodes a modified NphT7 polypeptide comprising an I147T amino acid substitution. In some embodiments, the isolated and purified polynucleotide herein encodes a modified NphT7 polypeptide comprising an F217V amino acid substitution. In some aspects, the isolated and purified polynucleotide herein encodes a modified NphT7 polypeptide comprising two or more amino acid substitutions, deletions, or insertions. In some aspects, the isolated and purified polynucleotide herein encodes a modified NphT7 polypeptide, comprising an I147T amino acid substitution and an F217V amino acid substitution. In some embodiments, the isolated and purified polynucleotide herein is a RNA, mRNA, DNA, or cDNA. In some embodiments, the isolated and purified polynucleotide herein is a synthetic polynucleotide. In some embodiments, the isolated and purified polynucleotide herein is synthetic: RNA, mRNA, DNA, or cDNA.

In one aspect, the present invention provides for a ketoacyl-CoA synthase that is active during the elongation phase in the malonyl-CoA dependent pathway, wherein the ketoacyl-CoA synthase is selected from the group consisting of npht7 F217V, npht7 I147T, synthase III, synthase IV, synthase V, and synthase VI; wherein npht7 F217V and/or npht7 I147T catalyzes a reaction adding the $5^{th}$ and/or $6^{th}$ carbon in the elongation, npht7 F217V, npht7 I147T, and/or synthase III catalyzes a reaction adding the 7th and/or $8^{th}$ carbon in the elongation, npht7 F217V, npht7 I147T, synthase III, synthase IV, and/or synthase V catalyzes a reaction adding the $9^{th}$ and/or $10^{th}$ carbon in the elongation, or wherein npht7 F217V, npht7 I147T, synthase III, synthase IV, synthase V, and/or synthase VI catalyzes a reaction adding the $9^{th}$ and/or higher number carbon in the elongation.

(2) Phase Two (Elongation)—Ketoacyl-CoA Reductase, 3-Hydroxyacyl-CoA Dehydratase and Enoyl-CoA Reductase Referring again to FIG. 7, in addition to a 3-ketoacyl-CoA synthase, each cycle of the malonyl-CoA dependent elongation phase requires a 3-ketoacyl-CoA reductase ("KCR"), a hydroxyacyl-CoA dehydratase ("3HDh"), and an enoyl-CoA reductase ("EnCr").

For the elongation phase, the ketoacyl-CoA reductase may be selected from the group consisting of 3-ketoacyl-CoA reductase (e.g., fadB, a bifunctional enzyme—SEQ ID NO 183) and 3-hydroxyacyl-CoA dehydrogenase (e.g., hbd—SEQ ID NO 271); the hydroxyacyl-CoA dehydratase may be selected from the group consisting of 3-hydroxyacyl-CoA dehydratase (e.g., fadB, a bifunctional enzyme—SEQ ID NO 183) and enoyl-CoA hydratase (e.g., crt—SEQ ID NO 272); and the enoyl-CoA reductase may be trans-2-enoyl-reductase (e.g., ter—SEQ ID NO 275). Preferably, the bifunctional fadB is both the ketoacyl-CoA reductase and the hydroxyacyl-CoA dehydratase, or the ketoacyl-CoA reductase is hbd and the hydroxyacyl-CoA dehydratase is crt.

C. Genetic Modifications to Drive Phase Three—Chain Length Termination

The elongation phase ends with a termination step once the desired chain length is achieved. In one aspect of the invention, the genetically modified microorganism encodes an enzyme capable of terminating an acyl elongation cycle substantially at a desired chain length or substantially within a relatively narrow distribution of chain lengths (i.e., a distribution of 2-4 carbons—e.g., C8-C10, C8-C12, C10-C12, C10-C14, etc.). In another aspect of the invention, the termination enzyme is a thioesterase such as an acyl-CoA esterase, and the microorganism produces a fatty acid.

Suitable thioesterases include tesA—SEQ ID NO 277, 'tesA—SEQ ID NO 278, tesB—SEQ ID NO 279, yciA—SEQ ID NO 280, ybgC—SEQ ID NO 281, ybfF—SEQ ID NO 282, fadM—SEQ ID NO 283, AtTE—SEQ ID NO 284, CpTE—SEQ ID NO 285, CperfTE—SEQ ID NO 286, LpTE—SEQ ID NO 287, and PA2801TE—SEQ ID NO 288, and combinations thereof. Alternatively, the termination enzyme is a wax ester synthase and the microorganism produces a fatty ester. Suitable wax ester synthase include Maq1—SEQ ID NO 289, Pcry1—SEQ ID NO 290, Rjos1—SEQ ID NO 291, and Abork1—SEQ ID NO 292. Alternatively, it is within the skill of the art to add other known termination enzyme(s) that will enable the genetically modified microorganism to produce alternative fatty acid derivatives such as, for example, a fatty alcohol, a fatty aldehyde, a fatty alkene, a fatty amide, a fatty alkane, or a fatty diacid. By way of example, the termination enzyme may be a fatty acid or acyl-CoA reductase that catalyzes the production of a fatty alcohol or fatty aldehyde, or an aldehyde decarbonylase that catalyzes the production of fatty aldehyde, or an aldehyde decarbonylase together with an acyl-ACP reductase or an acyl-CoA reductase that catalyzes the production of an alkane.

D. Genetic Modifications Associated with Specific Chain Lengths

In accordance with one aspect of the invention, the genetically modified microorganism is engineered to produce a fatty acid or fatty acid derivative product having substantially a specific chain length or having a substantially narrow distribution of chain lengths (i.e., 2-4 carbons). Preferably, at least 50%, 60%, 70%, 80%, or 90% of the fatty acids or fatty acid derivative produced by the genetically modified microorganism of the present invention is of a desired chain length or within a desired narrow distribution of chain lengths. Applicants have determined that such specificity may be achieved through engineering a microorganism to encode for various combinations of genes that will lead to the production of fatty acids and fatty acid derivatives having specific chain lengths. Table 2 below sets forth certain unique combinations of genes that lead to the production of products having the carbon chain lengths indicated in Table 2.

TABLE 2

Chain length specificity of fatty Acid products by the enzyme combinations in the fatty acid pathways.

| Product | pathway | synthase | KCR | 3HDh | EnCR | Thioesterase |
|---|---|---|---|---|---|---|
| C4 | A | nphT7 SEQ ID NO 1 | Hbd SEQ ID NO 271 | Crt SEQ ID NO 272 | Ter SEQ ID NO 275 | yciA SEQ ID NO 280 |
|  | B | npht7 SEQ ID NO 1 | fadB SEQ ID NO 183 | fadB SEQ ID NO 183 | ter SEQ ID NO 275 | yciA SEQ ID NO 280 |
| C6 | A | nphT7 SEQ ID NO 1 npht7 I147T, F217V | fadB SEQ ID NO 183 | fadB SEQ ID NO 183 | ter SEQ ID NO 275 | yciA SEQ ID NO 280 |
|  | B | npht7 SEQ ID NO 1 npht7 I147T, F217V | fadB SEQ ID NO 183 | fadB SEQ ID NO 183 | ter SEQ ID NO 275 | PA2801TE SEQ ID NO 288 |
| C8 | A | npht7 SEQ ID NO 1 | fadB SEQ ID NO 183 | fadB SEQ ID NO 183 | ter SEQ ID NO 275 | yciA SEQ ID NO 280 |
|  | B | npht7 SEQ ID NO 1 npht7 I147T, F217V synthase III | fabG SEQ ID NO 270 | Ech SEQ ID NO 273 | ter SEQ ID NO 275 | yciA SEQ ID NO 280 |
|  | C | npht7 SEQ ID NO 1 npht7 I147T, F217V synthase III | fadB SEQ ID NO 183 | fadB SEQ ID NO 183 | ter SEQ ID NO 275 | PA2801TE SEQ ID NO 288 |
|  | D | npht7 SEQ ID NO 1 npht7 I147T, F217V synthase III | fabG SEQ ID NO 270 | ech SEQ ID NO 273 | ter SEQ ID NO 275 | PA2801TE SEQ ID NO 288 |
| C10 | A | npht7 SEQ ID NO 1 npht7 I147T, F217V synthase III, IV, V | fadB SEQ ID NO 183 | fadB SEQ ID NO 183 | ter SEQ ID NO 275 | AtTE SEQ ID NO 284 |
|  | B | npht7 SEQ ID NO 1 npht7 I147T, F217V synthase III, IV, V | fabG SEQ ID NO 270 | ech SEQ ID NO 273 | ter SEQ ID NO 275 | AtTE SEQ ID NO 284 |
|  | C | npht7 SEQ ID NO 1 npht7 I147T, F217V synthase III, IV, V | fadB SEQ ID NO 183 | fadB SEQ ID NO 183 | ter SEQ ID NO 275 | ybgC SEQ ID NO 281 |
|  | D | npht7 SEQ ID NO 1 npht7 I147T, F217V synthase III, IV, V | fabG SEQ ID NO 270 | ech SEQ ID NO 273 | ter SEQ ID NO 275 | ybgC SEQ ID NO 281 |
| C12 | A | npht7 SEQ ID NO 1 npht7 I147T, F217V synthase III, IV, V, VI | fadB SEQ ID NO 183 | fadB SEQ ID NO 183 | ter SEQ ID NO 275 | tesA SEQ ID NO 278 |
|  | B | npht7 SEQ ID NO 1 npht7 I147T, F217V synthase III, IV, V, VI | fabG SEQ ID NO 270 | ech SEQ ID NO 273 | ter SEQ ID NO 275 | ybgC SEQ ID NO 281 |
|  | C | npht7 SEQ ID NO 1 npht7 I147T, F217V synthase III, IV, V, VI | fadJ SEQ ID NO 185 | fadJ SEQ ID NO 185 | ter SEQ ID NO 275 | ybfF SEQ ID NO 282 |
| C14-16 | A | npht7 SEQ ID NO 1 npht7 I147T, F217V synthase III, IV, V, VI | fadB SEQ ID NO 183 | fadB SEQ ID NO 183 | ter SEQ ID NO 275 | tesA SEQ ID NO 278 |
|  | B | npht7 SEQ ID NO 1 npht7 I147T, F217Vsynthase III, IV, V, VI | fadJ SEQ ID NO 185 | fadJ SEQ ID NO 185 | ter SEQ ID NO 275 | fadM SEQ ID NO 283 |
|  | A | npht7 SEQ ID NO 1 npht7 I147T, F217V synthase III, IV, V, VI | fadB SEQ ID NO 183 | fadB SEQ ID NO 183 | ter SEQ ID NO 275 fadE SEQ ID NO 180 ydiO SEQ ID NO 186 | tesA SEQ ID NO 278 |

TABLE 2-continued

Chain length specificity of fatty Acid products by the enzyme combinations in the fatty acid pathways.

| Product | pathway | synthase | KCR | 3HDh | EnCR | Thioesterase |
|---|---|---|---|---|---|---|
| | B | npht7 SEQ ID NO 1<br>npht7 I147T, F217V<br>synthase III, IV, V, VI | fadJ SEQ ID NO 185 | fadJ SEQ ID NO 185 | ter fadE<br>SEQ ID NO 180<br>ydiO SEQ ID NO 186 | fadM SEQ ID NO 283 |

In accordance with one aspect of the invention, there is provided a genetically modified microorganism having encoded therein the genes included in Table 2 for a given pathway, wherein such microorganism is capable of producing a fatty acid or fatty acid derivative having a carbon chain length indicated in Table 2 for such pathway. There is also provided a genetically modified microorganism having encoded therein the genes included in Table 2 above for a combination of pathways, wherein the microorganism is capable of producing fatty acids or fatty acid derivatives within a substantially narrow distribution of chain lengths corresponding to the carbon chain lengths indicated in Table 2 for such combination of pathways. For example, there is provided a genetically modified microorganism comprising NphT7, fadB, ter, AtTE, and tesA (C10 pathway A and C12 pathway A), wherein said microorganism is capable of producing a fatty acid composition comprising C10 and C12 fatty acids.

In another aspect, applicants have discovered that chain length specificity can be controlled by utilizing certain enzymes from certain specific species of organisms. Accordingly, the present invention provides one or more isolated and purified polynucleotides comprising exogenous nucleic acid molecules encoding proteins comprising a 3-oxoacyl-(acyl carrier protein) synthase III from a species selected from the group consisting of *Alishewanella aestuarii* B11 (SEQ ID NO 236), *Arcobacter butzleri* ED-1 (SEQ ID NO 262), *Clostridiales bacterium* 1_7_47_FAA (SEQ ID NO 248), *Gluconacetobacter oboediens* 174Bp2 (SEQ ID NO 259), *Gordonia aichiensis* NBRC 108223 (SEQ ID NO 267), *Mesorhizobium* sp. STM 4661 (SEQ ID NO 246), *Pelosinus fermentans* DSM 17108 (SEQ ID NO 106), *Phaeobacter gallaeciensis* 2.10 (SEQ ID NO 70), *Ralstonia solanacearum* Po82 (SEQ ID NO 63), *Saccharomonospora azurea* NA-128 (SEQ ID NO 57), *Saccharomonospora glauca* K62 (SEQ ID NO 109), and *Verrucosispora maxis* AB-18-032 (SEQ ID NO 113), wherein the proteins encoded by the polynucleotides are capable of producing a fatty acid.

In some embodiments, the 3-oxoacyl-(acyl carrier protein) synthase III is from a species selected from the group consisting of *Pelosinus fermentans* DSM 17108 (SEQ ID NO 106), *Saccharomonospora glauca* K62 (SEQ ID NO), *Verrucosispora maxis* AB-18-032 (SEQ ID NO 113), and *Clostridiales bacterium* 1_7_47_FAA (SEQ ID NO 248), and wherein the proteins encoded by the polynucleotides are capable of producing an acetyl-CoA. In some embodiments, the 3-oxoacyl-(acyl carrier protein) synthase III is from a species selected from the group consisting of *Saccharomonospora glauca* K62 (SEQ ID NO 109), *Saccharomonospora azurea* NA-128 (SEQ ID NO 57), *Mesorhizobium* sp. STM 4661 (SEQ ID NO 246), and *Clostridiales bacterium* 1_7_47_FAA (SEQ ID NO 248), and wherein the proteins encoded by the polynucleotides are capable of producing a four carbon fatty acid. In some embodiments, the 3-oxoacyl-(acyl carrier protein) synthase III is from a species selected from the group consisting of *Gordonia aichiensis* NBRC 108223 (SEQ ID NO 267), *Arcobacter butzleri* ED-1 (SEQ ID NO 262), *Clostridiales bacterium* 1_7_47_FAA (SEQ ID NO 248), *Saccharomonospora glauca* K62 (SEQ ID NO 109), and *Ralstonia solanacearum* Po82 (SEQ ID NO 63), and wherein the proteins encoded by the polynucleotides are capable of producing a six carbon fatty acid. In some embodiments, the 3-oxoacyl-(acyl carrier protein) synthase III is from a species selected from the group consisting of *Gordonia aichiensis* NBRC 108223 (SEQ ID NO 267), *Gluconacetobacter oboediens* 174Bp2 (SEQ ID NO 259), *Arcobacter butzleri* ED-1 (SEQ ID NO 262), *Ralstonia solanacearum* Po82 (SEQ ID NO 63), and *Phaeobacter gallaeciensis* 2.10 (SEQ ID NO 70), and wherein the proteins encoded by the polynucleotides are capable of producing an eight carbon fatty acid. In some embodiments, the 3-oxoacyl-(acyl carrier protein) synthase III is from *Alishewanella aestuarii* B11 (SEQ ID NO 236), and wherein the proteins encoded by the polynucleotides are capable of producing a ten carbon fatty acid.

E. Genetic Modifications to Redirect Malonyl-CoA from Native Malonyl-ACP Dependent Fatty Acid Synthesis to Malonyl-CoA Dependent Fatty Acid Synthesis As discussed above, certain aspects the present invention relate to microorganisms that are genetically modified to produce fatty acids and fatty acid derivatives through a malonyl-CoA dependent pathway that is also a malonyl-ACP independent pathway. This aspect of the invention may be used in combination with the inhibition of a microorganism's malonyl-ACP dependent fatty acid synthase pathway through one or more genetic modifications to reduce the activity of enzymes encoded by one or more of the microorganism's malonyl-ACP dependent fatty acid synthase system genes. The compositions may be used in the methods and systems of the present invention.

In many microorganism cells the fatty acid synthase system comprises polypeptides that have the following enzymatic activities: malonyl-CoA-acyl carrier protein (ACP) transacylase; 3-ketoacyl-ACP synthase; 3-keto acyl-ACP reductase; 3-hydroxyacyl-ACP dehydratase; 3-hydroxyacyl-ACP dehydratase; and enoyl-ACP reductase. In various embodiments nucleic acid sequences that encode temperature-sensitive forms of these polypeptides may be introduced in place of the native enzymes, and when such genetically modified microorganisms are cultured at elevated temperatures (at which these thermolabile polypeptides become inactivated, partially or completely, due to alterations in protein structure or complete denaturation), there is observed an increase in flux through the malonyl-CoA dependent pathway and a decrease in flux through the malonyl-ACP dependent pathway.

In *E. coli*, these temperature-sensitive mutant genes could include fabI$^{ts}$(S241F)(SEQ ID NO 141), fabB$^{ts}$(A329V) or fabD$^{ts}$(W257Q). In other embodiments other types of genetic modifications may be made to otherwise modulate, such as lower, enzymatic activities of one or more of these polypeptides. In various embodiments, a result of such genetic modifications is to shift malonyl-CoA utilization so that there is a reduced conversion of malonyl-CoA to fatty acids via the native pathway, overall biomass, and proportionally greater conversion of carbon source to a chemical product including a fatty acid or fatty acid derived product via a malonyl-CoA dependent, and in some cases a malonyl-ACP independent route. In various embodiments, the specific productivity for the microbially produced chemical product is unexpectedly high. Also, additional genetic modifications, such as to increase malonyl-CoA production, may be made for certain embodiments.

One enzyme, enoyl-acyl carrier protein reductase (EC No. 1.3.1.9, also referred to as enoyl-ACP reductase) is a key enzyme for fatty acid biosynthesis from malonyl-CoA. In *Escherichia coli* this enzyme, FabI (SEQ ID NO 132), is encoded by the gene fabI (See "Enoyl-Acyl Carrier Protein (fabI) Plays a Determinant Role in Completing Cycles of Fatty Acid Elongation in *Escherichia coli*," Richard J. Heath and Charles O. Rock, J. Biol. Chem. 270:44, pp. 26538-26543 (1995), incorporated by reference for its discussion of fabI and the fatty acid synthase system).

The present invention may utilize a microorganism that is provided with a nucleic acid sequence (polynucleotide) that encodes a polypeptide having enoyl-ACP reductase enzymatic activity that may be modulated during a fermentation event. For example, a nucleic acid sequence encoding a temperature-sensitive enoyl-ACP reductase may be provided in place of the native enoyl-ACP reductase, so that an elevated culture temperature results in reduced enzymatic activity, which then results in a shifting utilization of malonyl-CoA to production of a desired chemical product. One such sequence is a mutant temperature-sensitive fabI (fabI$^{TS}$) of *E. coli* or the fabI"(S241F) (SEQ ID NO 141). This enzyme may exhibit reduced enzymatic activity at temperatures above 30° C. but normal enzymatic activity at 30° C., so that elevating the culture temperature to, for example to 34° C., 35° C., 36° C., 37° C. or even 42° C., reduces enzymatic activity of enoyl-ACP reductase. In such case, more malonyl-CoA is converted to a fatty acid or fatty acid derived product or another chemical product through the non-native pathway under the current invention than at 30° C., where conversion of malonyl-CoA to fatty acids through its native fatty acid pathway is not impeded by a less effective enoyl-ACP reductase.

It is appreciated that nucleic acid and amino acid sequences for enoyl-ACP reductase in species other than *E. coli* are readily obtained by conducting homology searches in known genomics databases, such as BLASTN and BLASTP. Approaches to obtaining homologues in other species and functional equivalent sequences are described herein. Accordingly, it is appreciated that the present invention may be practiced by one skilled in the art for many microorganism species of commercial interest.

Approaches other than a temperature-sensitive enoyl-ACP reductase may be employed as known to those skilled in the art, such as, but not limited to, replacing a native enoyl-ACP or enoyl-CoA reductase with a nucleic acid sequence that includes an inducible promoter for this enzyme, so that an initial induction may be followed by no induction, thereby decreasing enoyl-ACP or enoyl-CoA reductase enzymatic activity after a selected cell density is attained. For example, a genetic modification may be made to reduce the enzymatic activity of the enoyl-ACP reductase gene (e.g., fabI in *E. coli*). In such example the promoter may be induced (such as with isopropyl-µ-D-thiogalactopyranoiside (IPTG)) during a first phase of a method herein, and after the IPTG is exhausted, removed or diluted out the second step, of reducing enoyl-ACP reductase enzymatic activity, may begin. Other approaches may be applied to control enzyme expression and activity such as are described herein and/or known to those skilled in the art. For example promoters that are turned on in response to phosphate depletion may be used to controllably express desired genes. Such promoters could include the yibD (SEQ ID NO 170) or pstS (SEQ ID NO 171) gene promoters in *E. coli*.

Without being bound to a particular theory, it is believed that reducing the enzymatic activity of enoyl-ACP reductase (and/or of other enzymes of the fatty acid synthase system) in a microorganism leads to an accumulation and/or shunting of malonyl-CoA, a metabolic intermediate upstream of the enzyme, and such malonyl-CoA may then be converted to a chemical product for which the microorganism cell comprises a metabolic pathway that utilizes malonyl-CoA. In certain compositions, methods and systems of the present invention the reduction of enzymatic activity of enoyl-ACP reductase (or, more generally, of the fatty acid synthase system) is made to occur after a sufficient cell density of a genetically modified microorganism is attained. This biphasic culture approach balances a desired quantity of biocatalyst, in the cell biomass which supports a particular production rate, with yield, which may be partly attributed to having less carbon be directed to cell mass after the enoyl-ACP reductase activity (and/or activity of other enzymes of the fatty acid synthase system) is/are reduced. This results in a shifting net utilization of malonyl-CoA, thus providing for greater carbon flux to a desired chemical product.

Once the modulation is in effect to decrease the noted enzymatic activity(ies), each respective enzymatic activity so modulated may be reduced by at least 10, at least 20, at least 30, at least 40, at least 50, at least 60, at least 70, at least 80, or at least 90 percent compared with the activity of the native, non-modulated enzymatic activity (such as in a cell or isolated). Similarly, the conversion of malonyl-CoA to fatty acyl-ACP or molecules may be reduced by at least 10, at least 20, at least 30, at least 40, at least 50, at least 60, at least 70, at least 80, or at least 90 percent compared with such conversion in a non-modulated cell or other system. Likewise, the conversion of malonyl-CoA to fatty acid molecules through its native pathway may be reduced by at least 10, at least 20, at least 30, at least 40, at least 50, at least 60, at least 70, at least 80, or at least 90 percent compared with such conversion in a non-modulated cell or other system.

F. Additional Genetic Modifications

The genetic modifications described hereinabove may be combined with various additional genetic modifications to further enhance production of a desired chemical product. Such additional genetic modifications may result in a variety of beneficial attributes, such as increasing glucose uptake, decreasing consumption of key intermediates by alternative reaction pathways leading to undesirable by-products, and driving carbon flux to malonyl-CoA. Certain of these additional genetic modifications are set forth in Table 3.

TABLE 3

| | | | |
|---|---|---|---|
| Genetic Modifications | | | |
| Enzyme Function | E.C. Classification | Gene Name in *E. coli* | Modifications |
| Glucose transporter | N/A | GalP (SEQ ID NO 177) | Increase function |
| Pyruvate dehydrogenase E1p | 1.2.4.1 | AceE (SEQ ID NO 151) | Increase function |
| lipoate acetyltransferase/ dihydrolipoamide acetyltransferase | 2.3.1.12 | AceF (SEQ ID NO 152) | Increase function |
| Pyruvate dehydrogenase E3 (lipoamide dehydrogenase) | 1.8.1.4 | Lpd (SEQ ID NO 153) | Increase function or alter such as by mutation to increase resistance to NADH inhibition, |
| Lactate dehydrogenase | 1.1.1.28 | LdhA (SEQ ID NO 124) | Decrease function, including by mutation |
| Pyruvate formate lyase (B "inactive") | 2.3.1.— | PflB (SEQ ID NO 125) | Decrease function, including by mutation |
| Pyruvate oxidase | 1.2.2.2 | PoxB (SEQ ID NO 127) | Decrease function, including by mutation |
| Phosphate acetyltransferase | 2.3.1.8 | Pta (SEQ ID NO 128) | Decrease function, including by mutation |
| acetate kinase | 2.7.2.15 2.7.2.1 | AckA (SEQ ID NO 129) | Decrease function, including by mutation |
| methylglyoxal synthase | 4.2.3.3 | MgsA (SEQ ID NO 126) | Decrease function, including by mutation |
| Heat stable, histidyl phosphorylatable protein (of PTS) | N/A | ptsH (HPr) | Decrease function, including by mutation |
| Phosphoryl transfer protein (of PTS) | N/A | ptsI | Decrease function, including by mutation |
| Polypeptide chain (of PTS) | N/A | Crr | Decrease function, including by mutation |
| 3-oxoacyl-ACP synthase I 3-oxoacyl-ACP synthase II monomer | 2.3.1.179 2.3.1.41 | FabF (SEQ ID NO 136) | Decrease or increase function, including by mutation |
| 3-ketoacyl-ACP synthase I, 3-oxoacyl-ACP-synthase I | 2.3.1.41 2.3.1.— | fabB (SEQ ID NO 133) | Decrease or increase function, including by mutation |
| Malonyl-CoA-ACP transacylase | 2.3.1.39 | fabD (SEQ ID NO 135) | Decrease or increase function, including by mutation |
| enoyl acyl carrier protein reductase | 1.3.1.9, 1.3.1.10 | fabI (SEQ ID NO 132) | Decrease or increase function, including by mutation |
| 3-ketoacyl-acyl carrier protein synthase III | 2.3.1.180 | fabH (SEQ ID NO 134) | Decrease or increase function, including by mutation |
| Carboxyl transferase subunit α subunit | 6.4.1.2 | accA (SEQ ID NO 147) | Increase function |
| Biotin carboxyl carrier protein | 6.4.1.2 | accB (SEQ ID NO 148) | Increase function |
| Biotin carboxylase subunit | 6.3.4.14 | accC (SEQ ID NO 149) | Increase function |
| Carboxyl transferase subunit β subunit | 6.4.1.2 | accD (SEQ ID NO 150) | Increase function |
| long chain fatty acyl thioesterase I | 3.1.2.2, 3.1.1.5 | tesA (SEQ ID NO 277) | Decrease or increase function as well as alter by mutation to express in cytoplasm. |
| acyl-CoA synthase | 2.3.1.86 | fadD (SEQ ID NO 181) | Decrease via deletion or mutation |
| acetate CoA-transferase | 2.8.3.8 | atoD (SEQ ID NO 190) | Decrease via deletion or mutation |

TABLE 3-continued

Genetic Modifications

| Enzyme Function | E.C. Classification | Gene Name in E. coli | Modifications |
|---|---|---|---|
| acetate CoA-transferase | 2.8.3.8 | atoA (SEQ ID NO 191) | Decrease via deletion or mutation |
| Transporter | | atoE (SEQ ID NO 192) | Decrease via deletion or mutation |
| acetyl-CoA acetyltransferase | 2.3.1.9 | atoB (SEQ ID NO 193) | Decrease via deletion or mutation |
| pantothenate kinase | 2.7.1.33 | coaA (SEQ ID NO 173) | Increase function |
| lactose repressor | | lacI | Decrease via deletion or mutation |
| γ-glutamyl-γ-aminobutyraldehyde dehydrogenase | 1.2.1.— | puuC | Decrease via deletion or mutation |
| malate synthase A | 2.3.3.9 | AceB (SEQ ID NO 157) | Decrease via deletion or mutation |
| isocitrate lyase | 4.1.3.1 | AceA (SEQ ID NO 156) | Decrease via deletion or mutation |
| isocitrate dehydrogenase phosphatase/isocitrate dehydrogenase kinase | 3.1.3.—2.7.11.5. | AceK (SEQ ID NO 158) | Decrease via deletion or mutation |
| pyruvate formate-lyase deactivase | 1.2.1.10 1.1.1.1 | adhE (SEQ ID NO 130) | Decrease via deletion or mutation |
| aldehyde dehydrogenase A, NAD-linked | 1.2.1.21 1.2.1.22 | aldA | Decrease via deletion or mutation |
| acetaldehyde dehydrogenase | 1.2.1.4 | aldB | Decrease via deletion or mutation |
| Lambda phage DE3 lysogen | | λDE3 | Increase function |
| T7 mRNA polymerase | | T7pol | Increase function |
| trigger factor | 5.2.1.8 | Tig (SEQ ID NO 189) | Decrease via deletion or mutation |
| 3-ketoacyl-CoA thiolase | 2.3.1.16 | FadA (SEQ ID NO 182) | Increase or decrease function |
| dodecenoyl-CoA δ-isomerase, enoyl-CoA hydratase, 3-hydroxybutyryl-CoA epimerase, 3-hydroxyacyl-CoA dehydrogenase | 5.3.3.8 1.1.1.35 5.1.2.3 4.2.1.17 | fadB (SEQ ID NO 183) | Increase or decrease function |
| Sucrose permease | | cscB (SEQ ID NO 175) | Increase function |
| Invertase | 3.2.1.26 | CscA (SEQ ID NO 174) | Increase function |
| fructokinase | 2.7.1.4 | cscK (SEQ ID NO 1173) | Increase function |
| carbonic anhydrase | 4.2.1.1 | cynT (SEQ ID NO 168) | Increase function |
| carbonic anhydrase | 4.2.1.1 | Can (SEQ ID NO 167) | Increase function |
| pyridine nucleotide transhydrogenase | 1.6.1.2 | PntAB (SEQ ID NOS 145-146) | Increase function |
| pyridine nucleotide transhydrogenase | 1.6.1.1 | udhA (SEQ ID NO 144) | Increase function |
| acyl-CoA thioesterase | 3.1.2.20 3.1.2.2 | yciA (SEQ ID NO 280) | Increase or decrease function |

TABLE 3-continued

Genetic Modifications

| Enzyme Function | E.C. Classification | Gene Name in E. coli | Modifications |
|---|---|---|---|
| thioesterase II | 3.1.2.20 3.1.2.2 | tesB (SEQ ID NO 279) | Increase or decrease function |
| thioesterase III | 3.1.2.— | fadM (SEQ ID NO 283) | Increase or decrease function |
| hydroxyphenylacetyl-CoA thioesterase | | paaI | Increase or decrease function |
| esterase/thioesterase | 3.1.2.28 | ybgC (SEQ ID NO 281) | Increase or decrease function |
| proofreading thioesterase in enterobactin biosynthesis | | entH | Increase or decrease function |
| acetoacetyl-CoA synthase | 2.3.1.194 | npth07 (SEQ ID NO 1) | Increase function |
| 3-ketoacyl-CoA synthase/ elongase | 2.3.1 | Elo1 | Increase function |
| 3-ketoacyl-CoA synthase/ elongase | 2.3.1 | Elo2 | Increase function |
| 3-ketoacyl-CoA synthase/ elongase | 2.3.1 | Elo3 | Increase function |
| 3-Hydroxybutyryl-CoA dehydrogenase | 1.1.1.157 | hbd (SEQ ID NO 271) | Increase function |
| 3-oxoacyl-CoA reductase | 1.1.1.100 | fabG (SEQ ID NO 270) | Increase function |
| enoyl-CoA hydratase | 4.2.1.17 | crt (SEQ ID NO 272) | Increase function |
| enoyl-CoA hydratase | 4.2.1.17 | ech2 (SEQ ID NO 274) | Increase function |
| Trans-2-enoyl-reductase | 1.3.1.9 | ter (SEQ ID NO 275) | Increase function |

In addition to the above-described genetic modifications, in various embodiments genetic modifications also are provided to increase the pool and availability of the cofactor NADPH, and/or, consequently, the NADPH/NADP$^+$ ratio. For example, in various embodiments for *E. coli*, this may be done by increasing activity, such as by genetic modification, of one or more of the following genes: pgi (in a mutated form), pntAB, overexpressed, gapA:gapN substitution/replacement, and disrupting or modifying a soluble transhydrogenase such as sthA, and/or genetic modifications of one or more of zwf, gnd, and edd.

Any of the genetic modifications described herein may be provided to species not having such functionality, or having a less than desired level of such functionality.

More generally, and depending on the particular metabolic pathways of a microorganism selected for genetic modification, any subgroup of genetic modifications may be made to decrease cellular production of fermentation product(s) selected from the group consisting of acetate, acetoin, acetone, acrylic, malate, fatty acid ethyl esters, glycerolipids, lipids, isoprenoids, glycerol, ethylene glycol, ethylene, propylene, butylene, isobutylene, ethyl acetate, vinyl acetate, other acetates, 1,4-butanediol, 2,3-butanediol, butanol, isobutanol, sec-butanol, butyrate, isobutyrate, 2-OH-isobutryate, 3-OH-butyrate, ethanol, isopropanol, D-lactate, L-lactate, pyruvate, itaconate, levulinate, glucarate, glutarate, caprolactam, adipic acid, propanol, isopropanol, fusel alcohols, and 1,2-propanediol, 1,3-propanediol, formate, fumaric acid, propionic acid, succinic acid, valeric acid, and maleic acid. Gene deletions may be made as disclosed generally herein, and other approaches may also be used to achieve a desired decreased cellular production of selected fermentation products.

In some embodiments, additional genetic modification is associated with a genotype or an enzyme selected from the group listed in Table 4-Table 13 below. The amino acid sequences of these enzymes are shown in Table 14.

TABLE 4

Base strain *E. coli* K12 BW25113
(Datsenko, K. A., and Wanner, B. L., Proc. Natl., Acad. Sci. USA 97: 6640-6645, 2000)

| Genotype | Function | EC # | Organism | Gene | Gene ID | Comments |
|---|---|---|---|---|---|---|
| F- | Mating negative | | *E. coli* | araD | b0061, | |
| | | | | araA | ECK0062 | |
| | | | | araB | b0062, | |

TABLE 4-continued

Base strain E. coli K12 BW25113
(Datsenko, K. A., and Wanner, B. L., Proc. Natl., Acad. Sci. USA 97: 6640-6645, 2000)

| Genotype | Function | EC # | Organism | Gene | Gene ID | Comments |
|---|---|---|---|---|---|---|
| Δ(araD-araB)567 | utilization of arabinose |  | E. coli | lacZ | ECK0063 b0063, ECK0064 b0344, ECK0341 | deletion of araB, araA, araD |
| ΔlacZ4787(::rrnB-3) | utilization of lactose |  |  |  |  | disruption of lacZ |
| LAM- | lambda phage lysogen deletion |  | E. coli | pyrE | b3642, ECK3632 |  |
| rph-1 | 1-bp deletion in pyrE |  | E. coli | rhaD rhaA rhaB | b3902, ECK3895 b3903, ECK3896 b3904, ECK3897 |  |
| Δ(rhaD-rhaB)568 | utilization of rhamnose |  | E. coli | araD araA araB | b0061, ECK0062 b0062, ECK0063 b0063, ECK0064 | deletion of araB, araA, araD |
| hsdR514 | restriction endonuclease R | 3.1.21.3 | E. coli | lacZ | b0344, ECK0341 |  |

TABLE 5

Host modifications for yield increase/byproduct elimination

| Enzyme | Function | Reaction | EC # | Organism | Gene | Gene ID | Comments |
|---|---|---|---|---|---|---|---|
| ldhA (SEQ ID NO 124) | lactate dehydrogenase | pyruvate + NADH = lactate + NAD | 1.1.1.28 | E. coli | ldhA | b1380, ECK1377, NC_000913.2 | deletion |
| pflB(SEQ ID NO 125) | pyruvate formate lyase | pyruvate + CoASH = acetyl-CoA + formate | 2.3.1.54 | E. coli | pflB | b0903, ECK0894 | deletion |
| mgsA(SEQ ID NO 126) | methylglyoxal synthase | dihydroxyacetone phosphate = methylglyoxal + Pi | 4.2.3.3 | E. coli | mgsA | b0963, ECK0954 | deletion |
| poxB(SEQ ID NO 127) | pyruvate oxidase | pyruvate + an ubiquinone = CO2 + an ubiquinol + acetate | 1.2.2.2 | E. coli | poxB | b9871, ECK0862, NP_415392 | deletion |
| pta(SEQ ID NO 128) | phosphotransacetylase | acetyl-CoA + Pi = acetyl-P + CoASH | 2.3.1.8 | E. coli | pta | b2296, ECK2291, | deletion |
| ack(SEQ ID NO 129) | acetate kinase | acetyl-P + ADP = acetate + ATP | 2.7.2.1 | E. coli | ackA | b2296, ECK2290, NP 416799 | deletion |
| adhE(SEQ ID NO 130) | bifunctional acetyl-CoA reductase/alcohol dehydrogenase | acetyl-CoA + NAD = acetaldehyde + NADH acetaldehyde + NAD = ethanol + NADH | 1.1.1.1, 1.2.1.10 | E. coli | adhE | b1241, ECK1235, MG4323 | deletion |

TABLE 6

Fatty acid synthesis (including temperature sensitive alleles used for increased malonyl-CoA availability)

| Enzyme | Function | Reaction | EC # | Organism | Gene | Gene ID | Comments |
|---|---|---|---|---|---|---|---|
| ACP (SEQ ID NO 131) | acyl carrier protein | none | none | E. coli | acpP | b1094, ECK1080, MG4178 |  |
| fabI(SEQ ID NO 132) | enoyl-ACP reductase | a trans-enoyl-acyl-ACP + NADH = an acyl-ACP + NAD | 1.3.1.9 | E. coli | fabI | b1288, ECK1283, NP_415804 | TS allele used: S241F |

TABLE 6-continued

Fatty acid synthesis (including temperature sensitive alleles used for increased malonyl-CoA availability)

| Enzyme | Function | Reaction | EC # | Organism | Gene | Gene ID | Comments |
|---|---|---|---|---|---|---|---|
| fabB(SEQ ID NO 133) | 3-keto-acyl-ACP synthase KASI | an acyl-ACP + malonyl-ACP = a 3-keto-acyl-ACP + CO2 + ACP-SH | 2.3.1.41 | E. coli | fabB | b2323, ECK2317 | TS allele used: A329V |
| fabH(SEQ ID NO 134) | 3-keto-acyl-ACP synthase KASIII | acetyl-CoA + malonyl-ACP = acetoacetyl-CoA + CO2 + ACP-SH | 2.3.1.180 | E. coli | fabH | b1091, ECK1077 | |
| fabD(SEQ ID NO 135) | malonyl-CoA: ACP transacylase | ACP-SH + malonyl-CoA = malonyl-ACP + CoASH | 2.3.1.29 2.3.1.85, 86 | E. coli | fabD | b1092, ECK1078, AP_002424 | TS allele used: W257Q |
| fabF(SEQ ID NO 136) | 3-keto-acyl-ACP synthase KASII | malonyl-ACP + acetyl-ACP = acetoacetyl-ACP + ACP + CO2 | 2.3.1.41, 2.3.1.179 | E. coli | fabF | b1095, ECK1081 | |
| fabG(SEQ ID NO 137) | 3-keto-acyl-ACP reductase (NADPH-dep) | 3-keto-acyl-ACP + NADPH = 3-OH-acyl-ACP + NADP | 1.1.1.100 | E. coli | fabG | b1093, ECK1079 | |
| fabA(SEQ ID NO 138) | 3-keto-hydroxyl-acyl-ACP dehydrase | 3-hydroxy-acyl-ACP = 3-enoyl-acyl-ACP + H2O | 4.2.1.60 | E. coli | fabA | b0954, ECK0945 | |
| fabZ(SEQ ID NO 139) | 3-keto-hydroxyl-acyl-ACP dehydrase | 3-hydroxy-acyl-ACP = 3-enoyl-acyl-ACP + H2O | 4.2.1.— | E. coli | fabZ | b0180, ECK0179, NP 414722 | |
| fabR(SEQ ID NO 140) | transcriptional repressor | none | none | E. coli | fabR | b3963, NP_418398 | |

TABLE 7

Malonyl-CoA synthesis and other genes related to optimizing flux

| Enzyme | Function | Reaction | EC # | Organism | Gene | Gene ID | Comments |
|---|---|---|---|---|---|---|---|
| udhA(SEQ ID NO 144) | NADP/NAD transhydrogenase (soluble) | NAD+ + NADPH = NADP+ + NADH | 1.6.1.1 | E. coli | udhA = sthA | b3962, ECK3954 | |
| pntAB(SEQ ID NOS 145-146) | NADP/NAD transhydrogenase (membrane, complex) | NADP+ + NADH = NADPH + NAD+ | 1.6.1.2 | E. coli | pntA, pntB | b1603, ECK1598 b1602, ECK1597 | |
| PDH(SEQ ID NO 151) | Pyruvate dehydrogenase, subunit E1 | pyruvate + NAD + CoASH = acetyl-CoA + NADH + CO2 | 1.2.4.1 | E. coli | aceE | b0114, NP_414656 | |
| PDH(SEQ ID NO 152) | Pyruvate dehydrogenase, subunit E2 | pyruvate + NAD + CoASH = acetyl-CoA + NADH + CO2 | 1.2.4.1 2.3.1.12 | E. coli | aceF | b0115, NP_414657 | |
| PDH(SEQ ID NO 153) | Lipoamide dehydrogenase of Pyruvate dehydrogenase complex | pyruvate + NAD + CoASH = acetyl-CoA + NADH + CO2 | 1.2.4.1 2.3.1.12, 1.8.1.4 | E. coli | lpd | b0116, ECK0115 | lpd* = NADH-resistant mutant E354K |
| coaA(SEQ ID NO 154) | pantothenate kinase | pantothenate + ATP = phosphopantothenate + ADP | 2.7.1.33 | E. coli | coaA (panK) | b3974, ECK3966 | coaA* = feedback-resistant variant R106A |
| panD(SEQ ID NO 155) | aspartate-1-decarboxylase (proenzyme) | aspartate = beta-alanine + CO2 | 4.1.1.11 | E. coli | panD | b0131, ECK0130 | |
| aceA(SEQ ID NO 156) | isocitrate lyase | isocitrate = glyoxylate + succinate | 4.1.3.1 | H. elongata | aceA | b4015, ECK4007 | |
| aceB(SEQ ID NO 157) | malate synthase | acetyl-CoA + glyoxylate + H2O = Malate + CoASH + H+ | 2.3.3.9 | H. elongata | aceB | b4014, ECK4006 | |

TABLE 7-continued

Malonyl-CoA synthesis and other genes related to optimizing flux

| Enzyme | Function | Reaction | EC # | Organism | Gene | Gene ID | Comments |
|---|---|---|---|---|---|---|---|
| aceK(SEQ ID NO 158) | isocitrate dehydrogenase kinase/phosphatase | phosphorylated isocitrate dehydrogenase = isodictrate dehydrogenase + Pi | 3.1.3.— | H. elongata | aceK | b4016, ECK4008 | |
| GAPDH(SEQ ID NO 159) | glyceraldehyde 3-P dehydrogenase | glyceraldehyde-3-P + NAD+ + Pi = 1,3-bisPi-glycerate + NADH + H+ | 1.2.1.12 | H. elongata | gapA | b1779, ECK1777 | |
| pyk(SEQ ID NO 160) | pyruvate kinase | pyruvate + ATP = ADP + P-enolpyruvate | 2.7.1.10 | E. coli | pykA | b1854, ECK1855 | |
| pyk(SEQ ID NO 161) | pyruvate kinase | pyruvate + ATP = ADP + P-enolpyruvate | 2.4.1.40 | E. coli | pykF | b1676, ECK1672 | |
| gltA(SEQ ID NO 162) | citrate synthase | oxaloacetate + acetyl-CoA = citrate + CoASH | 2.3.3.1 | E. coli | gltA | b0720, ECK0709 | |
| CS | citrate synthase | oxaloacetate + acetyl-CoA = citrate + CoASH | 2.3.3.1 | E. coli | Arthrobacter strain DS2-3R | AAC45662 | SKG loop insertion, K313L, A10E |
| bicA(SEQ ID NO 163) | bicarbonate transporter | bicarbonate (out) = bicarbonate (in) | none | E. coli | Synechococcus sp. PCC7942 | ABG46427 | |
| GOGAT(SEQ ID NO 164) | glutamate synthase complex (transaminating) | glutamine + 2-oxoglutarate + NADPH = 2 glutamate + NADP | 1.4.1.13 | E. coli | gltB, gltD | b3212, ECK3202 b3213, ECK3203 | |
| GOGAT(SEQ ID NO 165) | glutamate synthase complex (deaminating) | glutamate + NADP = 2-oxoglutarate + NH3 + NADPH | 1.4.1.4 | E. coli | gltB, gltD | b3212, ECK3202 b3213, ECK3203 | |
| gdh(SEQ ID NO 166) | glutamate dehydrogenase | glutamate + NADP = 2-oxoglutarate + NH3 + NADPH | 11.4.1.4 | E. coli | gdhA | b1761, ECK1759 | |
| can(SEQ ID NO 167) | carbonic anhydrase | CO2 + H20 = bicarbonate + H+ | 4.2.1.1 | E. coli | can | b0126, ECK0125 | |
| cynT(SEQ ID NO 168) | carbonic anhydrase | CO2 + H20 = bicarbonate + H+ | 4.2.1.1 | E. coli | cynT | b0339, ECK0336 | |
| cynS(SEQ ID NO 169) | cyanase | cyanate + bicarbonate = carbamate + CO2 | 4.2.1.104 | E. coli | cynS | b0340, ECK0337 | |
| yibD(SEQ ID NO 170) | predicted glycosyltransferase | none | none | E. coli | yibD | b3615, ECK3605 | P-regulated gene |
| pstS(SEQ ID NO 171) | Phosphate ABC transporter, Pi binding protein | Pi (out) + ATP = Pi (in) + ADP | 3.6.3.27 | Arthrobacter (Antarctic bacterium) strain DS2-3R | pstS | b3729, ECK3721 | P-regulated gene |

TABLE 8

Sugar transport and utilization

| Enzyme | Function | Reaction | EC # | Organism | Gene | Gene ID | Comments |
|---|---|---|---|---|---|---|---|
| cscA(SEQ ID NO 174) | sucrose hydrolase | sucrose = glucose + fructose | 3.2.1.48 | E. coli | cscA | CAA57219 | |
| cscB(SEQ ID NO 175) | sucrose transporter | sucrose (out) = sucrose (in) | none | E. coli | cscB | CAA57217 | N234D, I312V |
| cscK(SEQ ID NO 175) | fructokinase | fructose + ATP = fructose-P + ADP | 2.7.1.3 | E. coli | cscK | CAA57218 | |
| galP(SEQ ID NO 177) | galactose transporter | galactose (out) = galactose (in) | none | E. coli | galP | b2943, ECK2938 | |
| galK(SEQ ID NO 178) | galactokinase | galactose + ATP = galactose-P + ADP | 2.7.1.6 | E. coli | galK | b0757, ECK0746 | |

TABLE 9

Host modifications for fatty acid product

| Enzyme | Function | Reaction | EC # | Organism | Gene | Gene ID | Comments |
|---|---|---|---|---|---|---|---|
| fadE(SEQ ID NO 180) | acyl-CoA dehydrogenase | a saturated acyl-CoA + oxidized flavoprotein = a trans-enoyl-acyl-CoA + a reduced flavoprotein | 1.3.8.— | E. coli | fadE | b0221, ECK0222 | |
| fadD(SEQ ID NO 181) | fatty acyl-CoA synthetase | a saturated fatty acid + ATP + CoASH = acyl-CoA + AMP + PPi | 6.2.1.3 | E. coli | fadD | b1805, ECK1803 | deletion |
| fadA(SEQ ID NO 182) | 3-keto-acyl-CoA thiolase | acyl-CoA + acetyl-CoA = 3-ketoacyl-CoA + CoASH | 2.3.1.16 | E. coli | fadA | b3845, ECK3847 | |
| fadB(SEQ ID NO 183) | fatty acid oxidation complex | 3-ketoacyl-CoA → 3-hydroxyacyl-CoA → enoyl-CoA | 5.1.2.3, 1.1.1.35, 4.2.1.17, 5.3.3.8 | E. coli | fadB | b3846, ECK3838 | |
| fadI(SEQ ID NO 184) | 3-keto-acyl-CoA thiolase (anaerobic) | acyl-CoA + acetyl-CoA = 3-ketoacyl-CoA + CoASH | 2.3.1.16 | E. coli | fadI | b2342, ECK2336 | |
| fadJ(SEQ ID NO 185) | fatty acid oxidation complex (anaerobic) | 3-ketoacyl-CoA → 3-hydroxyacyl-CoA → enoyl-CoA | 5.1.2.3, 1.1.1.35, 4.2.1.17, 5.3.3.8 | E. coli | fadJ | b2341, ECK2335 | |
| ydiO(SEQ ID NO 186) | predicted enoyl-CoA reductase | enoyl-CoA + reduced flavoprotein = acyl-CoA + oxidized flavoprotein | 1.3.8.— | E. coli | ydiO | b1695, ECK1963 | |
| paaJ(SEQ ID NO 187) | 3-ketoacyl-CoA thiolase | acyl-CoA + acetyl-CoA = 3-keto-acyl-CoA + CoASH | 2.3.1.— | | paaJ | b1397, ECK1394 | |
| yqeF(SEQ ID NO 188) | predicted acyltransferase | | | E. coli | yqeF | b2844, ECK2842 | |
| tig(SEQ ID NO 189) | molecular chaperone | none | none | E. coli | tig | b0436, ECK0430 | deletion |
| atoD(SEQ ID NO 190) | Predicted acetate-CoA transferase, alpha subunit | acetoacetate + acetyl-CoA = acetoacetyl-CoA + acetate | 2.8.3.— | E. coli | atoD | b2221, ECK2214 | deletion |
| atoA(SEQ ID NO 191) | Predicted acetate-CoA transferase, beta subunit | acetoacetate + acetyl-CoA = acetoacetyl-CoA + acetate | 2.8.3.— | E. coli | atoA | b2222, ECK2215 | deletion |
| atoE(SEQ ID NO 192) | Predicted fatty acid transporter | | none | E. coli | atoE | b2223, ECK2216 | deletion |
| atoB(SEQ ID NO 193) | acetyl-CoA acetyltransferase | 2 acetyl-CoA = acetoacetyl-CoA + CoASH | 2.3.1.9 | E. coli | atoB | b2224, ECK2217 | deletion |

TABLE 10

Fatty acid pathway 3-keto-acyl-CoA synthases

| Enzyme | Function | Reaction | EC # | Organism | Gene ID |
|---|---|---|---|---|---|
| NphT7(SEQ ID NO 1) | acetoacetyl-CoA synthase | acetyl-CoA + malonyl-CoA = acetoacetyl-CoA + CoASH + CO2 | 2.3.1.— | Streptomyces Sp CL190 NphT7 | AB540131 |
| SaFabH(SEQ ID NO 194) | 3-ketoacyl-CoA synthase | a fatty acyl-CoA + malonyl-CoA = a 3-ketoacyl-CoA + CoASH + CO2 | 2.3.1.— | Staphylococcus aureus MW2 PRK09352 | GI:75765832 |
| BsFabH(SEQ ID NO 195) | 3-ketoacyl-CoA synthase | a fatty acyl-CoA + malonyl-CoA = a 3-ketoacyl-CoA + CoASH + CO2 | 2.3.1.— | Bacillus subtilis 168 fabH1 | YP_004207150 |

TABLE 10-continued

Fatty acid pathway 3-keto-acyl-CoA synthases

| Enzyme | Function | Reaction | EC # | Organism | Gene ID |
|---|---|---|---|---|---|
| PaFabH(SEQ ID NO 196) | 3-ketoacyl-CoA synthase | a fatty acyl-CoA + malonyl-CoA = a 3-ketoacyl-CoA + CoASH + CO2 | 2.3.1.— | *Pseudomonas aeruginosa* PAO1 PRK07515 | NP_251976 |
| MtFabH(SEQ ID NO 197) | 3-ketoacyl-CoA synthase | a fatty acyl-CoA + malonyl-CoA = a 3-ketoacyl-CoA + CoASH + CO2 | 2.3.1.— | *Mycobacterium tuberculosis* H37Rv fabH | CAB08984 |
| FabH(SEQ ID NO 198) | 3-ketoacyl-CoA synthase | a fatty acyl-CoA + malonyl-CoA = a 3-ketoacyl-CoA + CoASH + CO2 | 2.3.1.— | *Rhodothermus marinus* SG0.5JP17-172 | gi|345301988 |
| FabH(SEQ ID NO 199) | 3-ketoacyl-CoA synthase | a fatty acyl-CoA + malonyl-CoA = a 3-ketoacyl-CoA + CoASH + CO2 | 2.3.1.— | *Streptomyces davawensis* | gi|471324089 |
| FabH(SEQ ID NO 200) | 3-ketoacyl-CoA synthase | a fatty acyl-CoA + malonyl-CoA = a 3-ketoacyl-CoA + CoASH + CO2 | 2.3.1.— | *Chlamydophila pecorum* E58 | gi|330444499 |
| FabH(SEQ ID NO 201) | 3-ketoacyl-CoA synthase | a fatty acyl-CoA + malonyl-CoA = a 3-ketoacyl-CoA + CoASH + CO2 | 2.3.1.— | *Clostridium ultunense* Esp | gi|459068159 |
| FabH(SEQ ID NO 202) | 3-ketoacyl-CoA synthase | a fatty acyl-CoA + malonyl-CoA = a 3-ketoacyl-CoA + CoASH + CO2 | 2.3.1.— | *Corallococcus coralloides* DSM 2259 | gi|383454618 |
| FabH(SEQ ID NO 203) | 3-ketoacyl-CoA synthase | a fatty acyl-CoA + malonyl-CoA = a 3-ketoacyl-CoA + CoASH + CO2 | 2.3.1.— | *Desmospora* sp. 8437 | gi|333371191 |
| FabH(SEQ ID NO 204) | 3-ketoacyl-CoA synthase | a fatty acyl-CoA + malonyl-CoA = a 3-ketoacyl-CoA + CoASH + CO2 | 2.3.1.— | *Paenibacillus peoriae* KCTC 3763 | gi|390454110 |
| FabH(SEQ ID NO 205) | 3-ketoacyl-CoA synthase | a fatty acyl-CoA + malonyl-CoA = a 3-ketoacyl-CoA + CoASH + CO2 | 2.3.1.— | *Pelosinus fermentans* DSM 17108 | gi|392959403 |
| FabH(SEQ ID NO 206) | 3-ketoacyl-CoA synthase | a fatty acyl-CoA + malonyl-CoA = a 3-ketoacyl-CoA + CoASH + CO2 | 2.3.1.— | *Candidatus Solibacter usitatus* Ellin6076 | gi|116626090 |
| FabH(SEQ ID NO 207) | 3-ketoacyl-CoA synthase | a fatty acyl-CoA + malonyl-CoA = a 3-ketoacyl-CoA + CoASH + CO2 | 2.3.1.— | *Desulfotomaculum nigrificans* DSM 574 | gi|323702691 |
| FabH(SEQ ID NO 208) | 3-ketoacyl-CoA synthase | a fatty acyl-CoA + malonyl-CoA = a 3-ketoacyl-CoA + CoASH + CO2 | 2.3.1.— | *Saccharomonospora glauca* K62 | gi|384566084 |
| FabH(SEQ ID NO 209) | 3-ketoacyl-CoA synthase | a fatty acyl-CoA + malonyl-CoA = a 3-ketoacyl-CoA + CoASH + CO2 | 2.3.1.— | *Corallococcus coralloides* | gi|298162138 |
| FabH(SEQ ID NO 210) | 3-ketoacyl-CoA synthase | a fatty acyl-CoA + malonyl-CoA = a 3-ketoacyl-CoA + CoASH + CO2 | 2.3.1.— | *Legionella pneumophila* str. Corby | gi|148359775 |
| FabH(SEQ ID NO 211) | 3-ketoacyl-CoA synthase | a fatty acyl-CoA + malonyl-CoA = a 3-ketoacyl-CoA + CoASH + CO2 | 2.3.1.— | *Streptomyces avermitilis* | gi|15824218 |
| FabH(SEQ ID NO 212) | 3-ketoacyl-CoA synthase | a fatty acyl-CoA + malonyl-CoA = a 3-ketoacyl-CoA + CoASH + CO2 | 2.3.1.— | *Verrucosispora maris* AB-18-032 | gi|330468931 |
| FabH(SEQ ID NO 213) | 3-ketoacyl-CoA synthase | a fatty acyl-CoA + malonyl-CoA = a 3-ketoacyl-CoA + CoASH + CO2 | 2.3.1.— | *Rhodopirellula baltica* SH 1 | gi|32444698 |
| FabH(SEQ ID NO 214) | 3-ketoacyl-CoA synthase | a fatty acyl-CoA + malonyl-CoA = a 3-ketoacyl-CoA + CoASH + CO2 | 2.3.1.— | *Candidatus methylomirabilis oxyfera* | gi|392374495 |

TABLE 10-continued

Fatty acid pathway 3-keto-acyl-CoA synthases

| Enzyme | Function | Reaction | EC # | Organism | Gene ID |
|---|---|---|---|---|---|
| FabH(SEQ ID NO 215) | 3-ketoacyl-CoA synthase | a fatty acyl-CoA + malonyl-CoA = a 3-ketoacyl-CoA + CoASH + $CO_2$ | 2.3.1.— | *Thermaerobacter marianensis* | gi\|317121784 |
| FabH(SEQ ID NO 216) | 3-ketoacyl-CoA synthase | a fatty acyl-CoA + malonyl-CoA = a 3-ketoacyl-CoA + CoASH + $CO_2$ | 2.3.1.— | *Caldisericum exile* AZM16c01 | gi\|383787841 |
| FabH(SEQ ID NO 217) | 3-ketoacyl-CoA synthase | a fatty acyl-CoA + malonyl-CoA = a 3-ketoacyl-CoA + CoASH + $CO_2$ | 2.3.1.— | *Indibacter alkaliphilus* LW1 | gi\|404450648 |
| FabH(SEQ ID NO 218) | 3-ketoacyl-CoA synthase | a fatty acyl-CoA + malonyl-CoA = a 3-ketoacyl-CoA + CoASH + $CO_2$ | 2.3.1.— | *Candidatus amoebophilus asiaticus* 5a2 | gi\|189502112 |
| FabH(SEQ ID NO 219) | 3-ketoacyl-CoA synthase | a fatty acyl-CoA + malonyl-CoA = a 3-ketoacyl-CoA + CoASH + $CO_2$ | 2.3.1.— | *Flavobacterium* sp. F52 | gi\|395801183 |
| FabH(SEQ ID NO 220) | 3-ketoacyl-CoA synthase | a fatty acyl-CoA + malonyl-CoA = a 3-ketoacyl-CoA + CoASH + $CO_2$ | 2.3.1.— | *Anaeromyxobacter dehalogenans* 2CP-C | gi\|86159172 |
| FabH(SEQ ID NO 221) | 3-ketoacyl-CoA synthase | a fatty acyl-CoA + malonyl-CoA = a 3-ketoacyl-CoA + CoASH + $CO_2$ | 2.3.1.— | *Microcystis aeruginosa* NIES-843 | gi\|166364688 |
| FabH(SEQ ID NO 222) | 3-ketoacyl-CoA synthase | a fatty acyl-CoA + malonyl-CoA = a 3-ketoacyl-CoA + CoASH + $CO_2$ | 2.3.1.— | *Chloroflexus aggregans* DSM 9485 | gi\|219849850 |
| FabH(SEQ ID NO 223) | 3-ketoacyl-CoA synthase | a fatty acyl-CoA + malonyl-CoA = a 3-ketoacyl-CoA + CoASH + $CO_2$ | 2.3.1.— | *Lactobacillus hilgardii* ATCC 8290 | gi\|227523050 |
| FabH(SEQ ID NO 224) | 3-ketoacyl-CoA synthase | a fatty acyl-CoA + malonyl-CoA = a 3-ketoacyl-CoA + CoASH + $CO_2$ | 2.3.1.— | *Bartonella grahamii* as4aup | gi\|240850683 |
| FabH(SEQ ID NO 225) | 3-ketoacyl-CoA synthase | a fatty acyl-CoA + malonyl-CoA = a 3-ketoacyl-CoA + CoASH + $CO_2$ | 2.3.1.— | *Clostridium botulinum* D str. 1873 | gi\|253681256 |
| FabH(SEQ ID NO 226) | 3-ketoacyl-CoA synthase | a fatty acyl-CoA + malonyl-CoA = a 3-ketoacyl-CoA + CoASH + $CO_2$ | 2.3.1.— | *Vibrio cholerae* AM-19226 | gi\|254286853 |
| FabH(SEQ ID NO 227) | 3-ketoacyl-CoA synthase | a fatty acyl-CoA + malonyl-CoA = a 3-ketoacyl-CoA + CoASH + $CO_2$ | 2.3.1.— | *Propionibacterium acnes* J139 | gi\|282854072 |
| FabH(SEQ ID NO 228) | 3-ketoacyl-CoA synthase | a fatty acyl-CoA + malonyl-CoA = a 3-ketoacyl-CoA + CoASH + $CO_2$ | 2.3.1.— | *Streptomyces ghanaensis* ATCC 14672 | gi\|291439887 |
| FabH(SEQ ID NO 229) | 3-ketoacyl-CoA synthase | a fatty acyl-CoA + malonyl-CoA = a 3-ketoacyl-CoA + CoASH + $CO_2$ | 2.3.1.— | *Veillonella* sp. 6_1_27 | gi\|294791665 |
| FabH(SEQ ID NO 230) | 3-ketoacyl-CoA synthase | a fatty acyl-CoA + malonyl-CoA = a 3-ketoacyl-CoA + CoASH + $CO_2$ | 2.3.1.— | *Streptomyces* sp. C | gi\|302539498 |
| FabH(SEQ ID NO 231) | 3-ketoacyl-CoA synthase | a fatty acyl-CoA + malonyl-CoA = a 3-ketoacyl-CoA + CoASH + $CO_2$ | 2.3.1.— | *Streptomyces* sp. SA3_actF | gi\|318080591 |
| FabH(SEQ ID NO 232) | 3-ketoacyl-CoA synthase | a fatty acyl-CoA + malonyl-CoA = a 3-ketoacyl-CoA + CoASH + $CO_2$ | 2.3.1.— | uncultured *Aquificae bacterium* | gi\|374851360 |
| FabH(SEQ ID NO 233) | 3-ketoacyl-CoA synthase | a fatty acyl-CoA + malonyl-CoA = a 3-ketoacyl-CoA + CoASH + $CO_2$ | 2.3.1.— | *Saccharomonospora azurea* NA-128 | gi\|381164912 |

TABLE 10-continued

Fatty acid pathway 3-keto-acyl-CoA synthases

| Enzyme | Function | Reaction | EC # | Organism | Gene ID |
|---|---|---|---|---|---|
| FabH(SEQ ID NO 234) | 3-ketoacyl-CoA synthase | a fatty acyl-CoA + malonyl-CoA = a 3-ketoacyl-CoA + CoASH + $CO_2$ | 2.3.1.— | Ralstonia solanacearum Po82 | gi|386335197 |
| FabH(SEQ ID NO 235) | 3-ketoacyl-CoA synthase | a fatty acyl-CoA + malonyl-CoA = a 3-ketoacyl-CoA + CoASH + $CO_2$ | 2.3.1.— | Frankia sp. QA3 | gi|392946737 |
| FabH(SEQ ID NO 236) | 3-ketoacyl-CoA synthase | a fatty acyl-CoA + malonyl-CoA = a 3-ketoacyl-CoA + CoASH + $CO_2$ | 2.3.1.— | Alishewanella aestuarii B11 | gi|397172008 |
| FabH(SEQ ID NO 237) | 3-ketoacyl-CoA synthase | a fatty acyl-CoA + malonyl-CoA = a 3-ketoacyl-CoA + CoASH + $CO_2$ | 2.3.1.— | Brevibacillus sp. CF112 | gi|399047091 |
| FabH(SEQ ID NO 238) | 3-ketoacyl-CoA synthase | a fatty acyl-CoA + malonyl-CoA = a 3-ketoacyl-CoA + CoASH + $CO_2$ | 2.3.1.— | Sphingomonas sp. LH128 | gi|402823152 |
| FabH(SEQ ID NO 239) | 3-ketoacyl-CoA synthase | a fatty acyl-CoA + malonyl-CoA = a 3-ketoacyl-CoA + CoASH + $CO_2$ | 2.3.1.— | Alteromonas macleodii str. 'English Channel 673' | gi|407684813 |
| FabH(SEQ ID NO 240) | 3-ketoacyl-CoA synthase | a fatty acyl-CoA + malonyl-CoA = a 3-ketoacyl-CoA + CoASH + $CO_2$ | 2.3.1.— | Leptospirillum ferriphilum ML-04 | gi|410479651 |
| FabH(SEQ ID NO 241) | 3-ketoacyl-CoA synthase | a fatty acyl-CoA + malonyl-CoA = a 3-ketoacyl-CoA + CoASH + $CO_2$ | 2.3.1.— | Glaciecola polaris LMG 21857 | gi|410617776 |
| FabH(SEQ ID NO 242) | 3-ketoacyl-CoA synthase | a fatty acyl-CoA + malonyl-CoA = a 3-ketoacyl-CoA + CoASH + $CO_2$ | 2.3.1.— | Listeria monocytogenes J1-220 | gi|417318270 |
| FabH(SEQ ID NO 243) | 3-ketoacyl-CoA synthase | a fatty acyl-CoA + malonyl-CoA = a 3-ketoacyl-CoA + CoASH + $CO_2$ | 2.3.1.— | Mycobacterium avium subsp. paratuberculosis S397 | gi|417747984 |
| FabH(SEQ ID NO 244) | 3-ketoacyl-CoA synthase | a fatty acyl-CoA + malonyl-CoA = a 3-ketoacyl-CoA + CoASH + $CO_2$ | 2.3.1.— | Fusobacterium nucleatum subsp. polymorphum F0401 | gi|422338672 |
| FabH(SEQ ID NO 245) | 3-ketoacyl-CoA synthase | a fatty acyl-CoA + malonyl-CoA = a 3-ketoacyl-CoA + CoASH + $CO_2$ | 2.3.1.— | Mycobacterium liflandii 128FXT | gi|443491493 |
| FabH(SEQ ID NO 246) | 3-ketoacyl-CoA synthase | a fatty acyl-CoA + malonyl-CoA = a 3-ketoacyl-CoA + CoASH + $CO_2$ | 2.3.1.— | Mesorhizobium sp. STM 4661 | gi|474659331 |
| FabH(SEQ ID NO 247) | 3-ketoacyl-CoA synthase | a fatty acyl-CoA + malonyl-CoA = a 3-ketoacyl-CoA + CoASH + $CO_2$ | 2.3.1.— | Streptomyces coelicolor A3(2) | gi|21224866 |
| FabH(SEQ ID NO 248) | 3-ketoacyl-CoA synthase | a fatty acyl-CoA + malonyl-CoA = a 3-ketoacyl-CoA + CoASH + $CO_2$ | 2.3.1.— | Clostridiales bacterium 1_7_47_FAA | gi|239623103 |
| FabH(SEQ ID NO 249) | 3-ketoacyl-CoA synthase | a fatty acyl-CoA + malonyl-CoA = a 3-ketoacyl-CoA + CoASH + $CO_2$ | 2.3.1.— | Ruegeria sp. R11 | gi|254477647 |
| FabH(SEQ ID NO 250) | 3-ketoacyl-CoA synthase | a fatty acyl-CoA + malonyl-CoA = a 3-ketoacyl-CoA + CoASH + $CO_2$ | 2.3.1.— | Rothia dentocariosa ATCC 17931 | gi|311113478 |
| FabH(SEQ ID NO 251) | 3-ketoacyl-CoA synthase | a fatty acyl-CoA + malonyl-CoA = a 3-ketoacyl-CoA + CoASH + $CO_2$ | 2.3.1.— | Caldicellulosiruptor kristjanssonii 177R1B | gi|312793335 |
| FabH(SEQ ID NO 252) | 3-ketoacyl-CoA synthase | a fatty acyl-CoA + malonyl-CoA = a 3-ketoacyl-CoA + CoASH + $CO_2$ | 2.3.1.— | Thermus scotoductus SA-01 | gi|320449672 |

TABLE 10-continued

Fatty acid pathway 3-keto-acyl-CoA synthases

| Enzyme | Function | Reaction | EC # | Organism | Gene ID |
|---|---|---|---|---|---|
| FabH(SEQ ID NO 253) | 3-ketoacyl-CoA synthase | a fatty acyl-CoA + malonyl-CoA = a 3-ketoacyl-CoA + CoASH + $CO_2$ | 2.3.1.— | *Geobacter* sp. M18 | gi\|322421910 |
| FabH(SEQ ID NO 254) | 3-ketoacyl-CoA synthase | a fatty acyl-CoA + malonyl-CoA = a 3-ketoacyl-CoA + CoASH + $CO_2$ | 2.3.1.— | *Rhodococcus equi* ATCC 33707 | gi\|325677042 |
| FabH(SEQ ID NO 255) | 3-ketoacyl-CoA synthase | a fatty acyl-CoA + malonyl-CoA = a 3-ketoacyl-CoA + CoASH + $CO_2$ | 2.3.1.— | *Clostridium papyrosolvens* DSM 2782 | gi\|326203621 |
| FabH(SEQ ID NO 256) | 3-ketoacyl-CoA synthase | a fatty acyl-CoA + malonyl-CoA = a 3-ketoacyl-CoA + CoASH + $CO_2$ | 2.3.1.— | *Cellulomonas fimi* ATCC 484 | gi\|332670773 |
| FabH(SEQ ID NO 257) | 3-ketoacyl-CoA synthase | a fatty acyl-CoA + malonyl-CoA = a 3-ketoacyl-CoA + CoASH + $CO_2$ | 2.3.1.— | *Neisseria macacae* ATCC 33926 | gi\|340361349 |
| FabH(SEQ ID NO 258) | 3-ketoacyl-CoA synthase | a fatty acyl-CoA + malonyl-CoA = a 3-ketoacyl-CoA + CoASH + $CO_2$ | 2.3.1.— | *Rhodothermus marinus* SG0.5JP17-172 | gi\|345304635 |
| FabH(SEQ ID NO 259) | 3-ketoacyl-CoA synthase | a fatty acyl-CoA + malonyl-CoA = a 3-ketoacyl-CoA + CoASH + $CO_2$ | 2.3.1.— | *Gluconacetobacter oboediens* 174Bp2 | gi\|349685677 |
| FabH(SEQ ID NO 260) | 3-ketoacyl-CoA synthase | a fatty acyl-CoA + malonyl-CoA = a 3-ketoacyl-CoA + CoASH + $CO_2$ | 2.3.1.— | *Halomonas* sp. HAL1 | gi\|352106212 |
| FabH(SEQ ID NO 261) | 3-ketoacyl-CoA synthase | a fatty acyl-CoA + malonyl-CoA = a 3-ketoacyl-CoA + CoASH + $CO_2$ | 2.3.1.— | *Saccharomonospora cyanea* NA-134 | gi\|375098553 |
| FabH(SEQ ID NO 262) | 3-ketoacyl-CoA synthase | a fatty acyl-CoA + malonyl-CoA = a 3-ketoacyl-CoA + CoASH + $CO_2$ | 2.3.1.— | *Arcobacter butzleri* ED-1 | gi\|384154990 |
| FabH(SEQ ID NO 263) | 3-ketoacyl-CoA synthase | a fatty acyl-CoA + malonyl-CoA = a 3-ketoacyl-CoA + CoASH + $CO_2$ | 2.3.1.— | *Marinobacter adhaerens* HP15 | gi\|385331603 |
| FabH(SEQ ID NO 264) | 3-ketoacyl-CoA synthase | a fatty acyl-CoA + malonyl-CoA = a 3-ketoacyl-CoA + CoASH + $CO_2$ | 2.3.1.— | *Phaeobacter gallaeciensis* 2.10 | gi\|400755130 |
| FabH(SEQ ID NO 265) | 3-ketoacyl-CoA synthase | a fatty acyl-CoA + malonyl-CoA = a 3-ketoacyl-CoA + CoASH + $CO_2$ | 2.3.1.— | *Aeromonas hydrophila* SSU | gi\|423197564 |
| FabH(SEQ ID NO 266) | 3-ketoacyl-CoA synthase | a fatty acyl-CoA + malonyl-CoA = a 3-ketoacyl-CoA + CoASH + $CO_2$ | 2.3.1.— | *Rhodococcus opacus* PD630 | gi\|424853848 |
| FabH(SEQ ID NO 267) | 3-ketoacyl-CoA synthase | a fatty acyl-CoA + malonyl-CoA = a 3-ketoacyl-CoA + CoASH + $CO_2$ | 2.3.1.— | *Gordonia aichiensis* NBRC 108223 | gi\|441509582 |
| FabH(SEQ ID NO 268) | 3-ketoacyl-CoA synthase | a fatty acyl-CoA + malonyl-CoA = a 3-ketoacyl-CoA + CoASH + $CO_2$ | 2.3.1.— | *Acinetobacter* sp. NIPH 236 | gi\|479875377 |
| PaFabG(SEQ ID NO 269) | 3-ketoacyl-CoA reductase | a 3-ketoacyl-CoA + NADH = a 3-hydroxyacyl-CoA + NAD+ | 1.1.1.35 | *Pseudomonas aeruginosa* PAO1 | NP_251657 |
| fabG(SEQ ID NO 270) | 3-ketoacyl-CoA reductase | a 3-ketoacyl-CoA + NADH = a 3-hydroxyacyl-CoA + NAD+ | 1.1.1.35 | *Pseudomonas aeruginosa* PA7 | ABR85110 |
| hbd(SEQ ID NO 271) | 3-hydroxybutyryl-CoA dehydrogenase | acetoacetyl-CoA + NADH = 3-hydroxybutyryl-CoA + NAD+ | 1.1.1.35 | *Clostridium beijerinckii* | AF494018_5 |

TABLE 10-continued

Fatty acid pathway 3-keto-acyl-CoA synthases

| Enzyme | Function | Reaction | EC # | Organism | Gene ID |
|---|---|---|---|---|---|
| crt(SEQ ID NO 272) | crotonase/enoyl-CoA hydratase | 3-hydroxybutyryl-CoA = crotonyl-CoA + H2O | 4.2.1.55 | Clostridium acetobutylicum | AAA95967 |
| ech(SEQ ID NO 272) | enoyl-CoA hydratase | 3-hydroxybutyryl-CoA = crotonyl-CoA + H2O | 4.2.1.55 | Pseudomonas putida | ABA10805 |
| ech2(SEQ ID NO 274) | bifunctional 3-hydroxyacyl-CoA dehydrogenase/ enoyl-CoA hydratase | a 3-ketoacyl-CoA + NADH = a 3-hydroxyacyl-CoA + NAD+ 3-hydroxyacyl-CoA = enoyl-CoA + H2O | 1.1.1.35 4.2.1.55 | Rattus norvegicus | NP_077368 |
| ter(SEQ ID NO 275) | crotonase/enoyl-CoA hydratase | a enoyl-CoA + NADH = a fattyacyl-CoA + NAD+ | 1.1.1.36 | Treponema denticola TDE0597 | WP_002681770 |
| ccr(SEQ ID NO 276) | crotonase/enoyl-CoA hydratase | a enoyl-CoA + NADH = a fattyacyl-CoA + NAD+ | 1.1.1.36 | Streptomyces collinus | GI:81309006, Q53865 |

TABLE 11

Thioesterases

| Enzyme | Function | Reaction | EC # | Organism | Gene | Gene ID | Comments |
|---|---|---|---|---|---|---|---|
| TesA (SEQ ID NO 277) | acyl-CoA thioesterase, protease, phosphlipase (periplasmic) | acyl-ACP + H2O = fatty acid + ACP acyl-CoA + H2O = fatty acid + CoASH | 3.1.2.14 3.1.2.2 | E. coli | tesA | b0494, ECK0488 | |
| 'tesA (SEQ ID NO 278) | acyl-CoA thioesterase (cytoplasmic) | acyl-ACP + H2O = fatty acid + ACP acyl-CoA + H2O = fatty acid + CoASH | 3.1.2.14 3.1.2.2 | E. coli | 'tesA | | del2-24 (signal sequence) |
| tesB (SEQ ID NO 279) | thioesterase | acyl-CoA + H2O = fatty acid + CoASH | 3.1.2.20 | E. coli | tesB | b0452, ECK0446 | |
| yciA (SEQ ID NO 280) | acyl-CoA thioesterase | acyl-CoA + H2O = fatty acid + CoASH | 3.1.2.20 | E. coli | yciA | b1253, ECK1247 | |
| ybgC (SEQ ID NO 281) | acyl-CoA thioesterase | acyl-CoA + H2O = fatty acid + CoASH | 3.1.2.28 | E. coli | ybgC | b0736, ECK0725 | |
| ybfF (SEQ ID NO 282) | predicted thioesterase | acyl-CoA + H2O = fatty acid + CoASH | 3.1.2.20 | E. coli | ybfF | b0686, ECK0674 | |
| fadM (SEQ ID NO 283) | thioesterase | acyl-CoA + H2O = fatty acid + CoASH | 3.1.2.— | E. coli | fadM | b0443, ECK0437 | |
| AtTE (SEQ ID NO 284) | thioesterase | acyl-CoA + H2O = fatty acid + CoASH | 3.1.2.20 | Anaerococcus tetradius ATCC35098 | | EEI82564 | |
| CpTE (SEQ ID NO 285) | thioesterase | acyl-CoA + H2O = fatty acid + CoASH | 3.1.2.20 | Cuphea palustris | | AAC49179 | |
| CperfTE (SEQ ID NO 286) | thioesterase | acyl-CoA + H2O = fatty acid + CoASH | 3.1.2.20 | Clostridium perfringens ATCC13124 | | ABG82470 | |
| LpTE (SEQ ID NO 287) | thioesterase | acyl-CoA + H2O = fatty acid + CoASH | 3.1.2.20 | Lactobacillus plantarum ACFS1 fat | | CAD63310 | |
| PA2801TE (SEQ ID NO 288) | thioesterase | acyl-CoA + H2O = fatty acid + CoASH | 3.1.2.20 | Pseudomonas aeruginosa PAO1 | | NP_251491 | |

TABLE 12

Wax ester synthases

| Enzyme | Function | Reaction | EC # | Organism | Gene ID |
|---|---|---|---|---|---|
| Maq1(SEQ ID NO 289) | Wax ester synthase | a fatty acyl-CoA + an alcohol = a fatty acyl methyl ester + CoASH | 2.3.1.20 | Marinobacter aquaeolei VT8 (ATCC700491) Ma1 | YP_957462 |
| Pcry1(SEQ ID NO 290) | Wax ester synthase | a fatty acyl-CoA + an alcohol = a fatty acyl methyl ester + CoASH | 2.3.1.20 | Psychrobacter cryohalolentis K5 Ps1 | YP_579515 |
| Rjos1(SEQ ID NO 291) | Wax ester synthase | a fatty acyl-CoA + an alcohol = a fatty acyl methyl ester + CoASH | 2.3.1.20 | Rhodococcus jostii RHA1 Rh1 | YP_701572 |
| Abork1(SEQ ID NO 292) | Wax ester synthase | a fatty acyl-CoA + an alcohol = a fatty acyl methyl ester + CoASH | 2.3.1.20 | Alcanivorax borkumensis strain SK2 atfA1 | YP_694462 |

TABLE 13

Miscellaneous

| Enzyme | Function | Reaction | EC # | Source/Genes E. coli unless noted | Gene ID | Comments |
|---|---|---|---|---|---|---|
| prpE(SEQ ID NO 293) | propionyl-CoA synthetase | propionate + CoASH + ATP = propionyl-CoA + AMP + PPi | 6.2.1.17 | Salmonella enterica subsp typhimirium | NP_454966 | |
| phaA(SEQ ID NO 294) | acetyl-CoA acetyltransferase/ thiolase | 2 acetyl-CoA = acetoacetyl-CoA + CoASH | 2.3.1.9 | Cupriavides necator (Rhodobacter sphaeroides 2.4.1) | YP_353824 | |
| phaB(SEQ ID NO 295) | acetoacetyl-CoA reductase | 3-ketoacyl-CoA + NAD(P)H = 3-hydroxyacyl-CoA + NAD(P)+ | 1.1.1.35 | Cupriavides necator (Rhodobacter sphaeroides 2.4.1) | YP_353825 | |
| phaC(SEQ ID NO 296) | PHA synthase | hydroxyacyl-CoA + [hydroxyalkanoate]n = [hydroxyalkanoate]n + 1 + CoASH | 2.3.1.— | Pseudomonas stutzeri phaC1 | AAO59383 | |
| phaC(SEQ ID NO 297) | PHA synthase | hydroxyacyl-CoA + [hydroxyalkanoate]n = [hydroxyalkanoate]n + 1 + CoASH | 2.3.1.— | Pseudomonas oleovorans | AAA25932 | |
| phaC(SEQ ID NO 298) | PHA synthase | hydroxyacyl-CoA + [hydroxyalkanoate]n = [hydroxyalkanoate]n + 1 + CoASH | 2.3.1.— | Pseudomonas aeruginosa PAO1 | AAG08441 | |
| THNS | THN synthase | 5 malonyl-CoA = THN (tetrahydroxynaphthalene) → flaviolin | unknown | Streptomycs coelicolor bcsA | CAC01488 | |
| THNS" | THN synthase variant C184S, del25 | 5 malonyl-CoA = THN (tetrahydroxynaphthalene) → flaviolin | unknown | Streptomycs coelicolor bcsA | CAC01488 | C184S, del351-374 |

TABLE 14

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| Host modifications for yield increase / byproduct elimination | | | |
| SEQ ID NO: 124 | ldhA | >gi\|16129341\|ref\|NP_415898.11 fermentative D-lactate dehydrogenase, NAD-dependent [Escherichia coli str. | MKLAVYSTKQYDKKYLQQVNESFGFELEFF DFLLTEKTAKTANGCEAVCIFVNDDGSRPVL EELKKHGVKYIALRCAGFNNVDLDAAKELG LKVVRVPAYDPEAVAEHAIGMMMTLNRRIH RAYQRTRDANFSLEGLTGFTMYGKTAGVIG TGKIGVAMLRILKGFGMRLLAFDPYPSAAAL |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | K-12 substr. MG1655] | ELGVEYVDLPTLFSESDVISLHCPLTPENYHL LNEAAFEQMKNGVMIVNTSRGALIDSQAAIE ALKNQKIGSLGMDVYENERDLFFEDKSNDVI QDDVFRRLSACHNVLFTGHQAFLTAEALTSI SQTTLQNLSNLEKGETCPNELV |
| SEQ ID NO: 125 | pflB | >gi\|16128870\|ref\|NP_ 415423.1\| pyruvate formate lyase I [Escherichia coli str. K-12 substr. MG1655] | MSELNEKLATAWEGFTKGDWQNEVNVRDFI QKNYTPYEGDESFLAGATEATTTLWDKVME GVKLENRTHAPVDFDTAVASTITSHDAGYIN KQLEKIVGLQTEAPLKRALIPFGGIKMIEGSC KAYNRELDPMIKKIFTEYRKTHNQGVFDVY TPDILRCRKSGVLTGLPDAYGRGRIIGDYRR VALYGIDYLMKDKLAQFTSLQADLENGVNL EQTIRLREEIAEQHRALGQMKEMAAKYGYD ISGPATNAQEAIQWTYFGYLAAVKSQNGAA MSFGRTSTFLDVYIERDLKAGKITEQEAQEM VDHLVMKLRMVRFLRTPEYDELFSGDPIWA TESIGGMGLDGRTLVTKNSFRPLNTLYTMGP SPEPNMTILWSEKLPLNFKKFAAKVSIDTSSL QYENDDLMRPDFNNDDYAIACCVSPMIVGK QMQFFGARANLAKTMLYAINGGVDEKLKM QVGPKSEPIKGDVLNYDEVMERMDHFMDW LAKQYITALNIIHYMHDKYSYEASLMALHD RDVIRTMACGIAGLSVAADSLSAIKYAKVKP IRDEDGLAIDFEIEGEYPQFGNNDPRVDDLA VDLVERFMKKIQKLHTYRDAIPTQSVLTITSN VVYGKKTGNTPDGRRAGAPFGPGANPMHG RDQKGAVASLTSVAKLPFAYAKDGISYTFSI VPNALGKDDEVRKTNLAGLMDGYFHHEASI EGGQHLNVNVMREMLLDAMENPEKYPQL TIRVSGYAVRFNSLTKEQQQDVITRTFTQSM |
| SEQ ID NO: 126 | mgsA | >gi\|90111195\|ref\|NP_ 415483.21 methylglyoxal synthase [Escherichia coli str. K-12 substr. MG1655] | MELTTRTLPARKHIALVAHDHCKQMLMSW VERHQPLLEQHVLYATGTTGNLISRATGMN VNAMLSGPMGGDQQVGALISEGKIDVLIFF WDPLNAVPHDPDVKALLRLATVWNIPVATN VATADFIIQSPHFNDAVDILIPDYQRYLADRL K |
| SEQ ID NO: 127 | poxB | >gi\|16128839\|ref\|NP_ 415392.1\| pyruvate dehydrogenase (pyruvate oxidase), thiamin-dependent, FAD-binding [Escherichia coli str. K-12 substr. MG1655] | MKQTVAAYIAKTLESAGVKRIWGVTGDSLN GLSDSLNRMGTIEWMSTRHEEVAAFAAGAE AQLSGELAVCAGSCGPGNLHLINGLFDCHRN HVPVLAIAAHIPSSEIGSSYFQETHPQELFREC SHYCELVSSPEQIPQVLAIAMRKAVLNRGVS VVVLPGDVALKPAPEGATMHWYHAPQPVV TPEEEELRKLAQLLRYSSNIALMCGSGCAGA HKELVEFAGKIKAPIVHALRGKEHVEYDNPY DVGMTGLIGFSSGFHTMMNADTLVLLGTQF PYRAFYPTDAKIIQIDINPASIGAHSKVDMAL VGDIKSTLRALLPLVEEKADRKFLDKALEDY RDARKGLDDLAKPSEKAIHPQYLAQQISHFA ADDAIFTCDVGTPTVWAARYLKMNGKRRLL GSFNHGSMANAMPQALGAQATEPERQVVA MCGDGGFSMLMGDFLSVVQMKLPVKIVVF NNSVLGFVAMEMKAGGYLTDGTELHDTNF ARIAEACGITGIRVEKASEVDEALQRAFSIDG PVLVDVVAKEELAIPPQIKLEQAKGFSLYM LRAIISGRGDEVIELAKTNWLR |
| SEQ ID NO: 128 | pta | >gi\|16130232\|ref\|NP_ 416800.11 phosphate acetyltransferase [Escherichia coli str. K-12 substr. MG1655] | MSRIIMLIPTGTSVGLTSVSLGVIRAMERKGV RLSVFKPIAQPRTGGDAPDQTTTIVRANSSTT TAAEPLKMSYVEGLLSSNQKDVLMEEIVAN YHANTKDAEVVLVEGLVPTRKHQFAQSLNY EIAKTLNAEIVFVMSQGTDTPEQLKERIELTR NSFGGAKNTNITGVIVNKLNAPVDEQGRTRP DLSEIFDDSSKAKVNNVDPAKLQESSPLPVL GAVPWSFDLIATRAIDMARHLNATIINEGDIN TRRVKSVTFCARSIPHMLEHFRAGSLLVTSA DRPDVLVAACLAAMNGVEIGALLLTGGYEM DARISKLCERAFATGLPVFMVNTNTWQTSLS LQSFNLEVPVDDHERIEKVQEYVANYINAD WIESLTATSERSRRLSPPAFRYQLTELARKAG KRIVLPEGDEPRTVKAAAICAERGIATCVLLG NPAEINRVAASQGVELGAGIEIVDPEVVRES YVGRLVELRKNKGMTETVAREQLEDNVVL |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | | GTLMLEQDEVDGLVSGAVHTTANTIRPPLQL IKTAPGSSLVSSVFFMLLPEQVYVYGDCAINP DPTAEQLAEIAIQSADSAAAFGIEPRVAMLSY STGTSGAGSDVEKVREATRLAQEKRPDLMID GPLQYDAAVMADVAKSKAPNSPVAGRATV FIFPDLNTGNTTYKAVQRSADLISIGPMLQG MRKPVNDLSRGALVDDIVYTIALTAIQSAQQ Q |
| SEQ ID NO: 129 | ack | >gi\|16130231\|ref\|NP_ 416799.1\| acetate kinase Aand propionate kinase 2 [*Escherichia coli* str. K-12 substr. MG1655] | MSSKLVLVLNCGSSSLKFAIIDAVNGEEYLS GLAECFHLPEARIKWKMDGNKQEAALGAG AAHSEALNFIVNTILAQKPELSAQLTAIGHRI VHGGEKYTSSVVIDESVIQGIKDAASFAPLH NPAHLIGIEEALKSFPQLKDKNVAVFDTAFH QTMPEESYLYALPYNLYKEHGIRRYGAHGT SHFYVTQEAAKMLNKPVEELNIITCHLGNGG SVSAIRNGKCVDTSMGLTPLEGLVMGTRSG DIDPAIIFHLHDTLGMSVDAINKLLTKESGLL GLTEVTSDCRYVEDNYATKEDAKRAMDVY CHRLAKYIGAYTALMDGRLDAVVFTGGIGE NAAMVRELSLGKLGVLGFENDHERNLAARF GKSGFINKEGTRPAVVIPTNEELVIAQDASRL TA |
| SEQ ID NO: 130 | adhE | >gi\|16129202\|ref\|NP_ 415757.1\| fused acetaldehyde-CoA dehydrogenase/iron-dependent alcohol dehydrogenase/pyruva te-formate lyase deactivase [*Escherichia coli* str. K-12 substr. MG1655] | MAVTNVAELNALVERVKKAQREYASFTQE QVDKIFRAAALAAADARIPLAKMAVAESGM GIVEDKVIKNHFASEYIYNAYKDEKTCGVLS EDDTFGTITIAEPIGIICGIVPTTNPTSTAIFKSL ISLKTRNAIIFSPHPRAKDATNKAADIVLQAA IAAGAPKDLIGWIDQPSVELSNALMHHPDIN LILATGGPGMVKAAYSSGKPAIGVGAGNTP VVIDETADIKRAVASVLMSKTFMGVICASE QSVVVVDSVYDAVRERFATHGGYLLQGKEL KAVQDVILKNGALNAAIVGQPAYKIAELAGF SVPENTKILIGEVTVVDESEPPAHEKLSPTLA MYRAKDFEDAVEKAEKLVAMGGIGHTSCL YTDQDNQPARVSYFGQKMKTARILINTPASQ GGIGDLYNFKLAPSLTLGCGSWGGNSISENV GPKHLINKKTVAKRAENMLWHKLPKSIYFR RGSLPIALDEVITDGHKRALIVTDRFLFNNGY ADQITSVLKAAGVETEVFFEVEADPTLSIVRK GAELANSFKPDVIIALGGGSPMDAAKIMWV MYEHPETHFEELALRFMDIRKRIYKFPKMGV KAKMIAVTTTSGTGSEVTPFAVVTDDATGQ KYPLADYALTPDMAIVDANLVMDMPKSLC AFGGLDAVTHAMEAYVSVLASEFSDGQALQ ALKLLKEYLPASYHEGSKNPVARERVHSAA TIAGIAFANAFLGVCHSMAHKLGSQFHIPHG LANALLICNVIRYNANDNPTKQTAFSQYDRP QARRRYAEIADHLGLSAPGDRTAAKIEKLLA WLETLKAELGIPKSIREAGVQEADFLANVDK LSEDAFDDQCTGANPRYPLISELKQILLDTYY GRDYVEGETAAKKEAAPAKAEKKAKKSA |

Fatty acid synthesis (including temperature sensitive alleles used for increased malonyl-CoA availability)

| SEQ ID NO | Enzyme | FASTA Header | Protein Sequence - NCBI Database |
|---|---|---|---|
| SEQ ID NO: 131 | ACP | >gi\|16129057\|ref\|NP_ 415612.1\| acyl carrier protein (ACP) [*Escherichia coli* str. K-12 substr. MG1655] | MSTIEERVKKIIGEQLGVKQEEVTNNASFVE DLGADSLDTVELVMALEEEFDTEIPDEEAEKI TTVQAAIDYINGHQA |
| SEQ ID NO: 132 | fabI | >gi\|16129249\|ref\|NP_ 415804.1\| enoyl-[acyl-carrier-protein] reductase, NADH-dependent [*Escherichia coli* str. K-12 substr. MG1655] | MGFLSGKRILVTGVASKLSIAYGIAQAMHRE GAELAFTYQNDKLKGRVEEFAAQLGSDIVL QCDVAEDASIDTMFAELGKVWPKFDGFVHS IGFAPGDQLDGDYVNAVTREGFKIAHDISSY SFVAMAKACRSMLNPGSALLTLSYLGAERAI PNYNVMGLAKASLEANVRYMANAMGPEGV RVNAISAGPIRTLAASGIKDFRKMLAHCEAV TPIRRTVTIEDVGNSAAFLCSDLSAGISGEVV HVDGGFSIAAMNELELK |
| SEQ ID NO: 133 | fabB | >gi\|16130258\|ref\|NP_ 416826.1\| 3-oxoacyl- | MKRAVITGLGIVSSIGNNQQEVLASLREGRS GITFSQELKDSGMRSHVWGNVKLDTTGLIDR |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | [acyl-carrier-protein] synthase I [*Escherichia coli* str. K-12 substr. MG1655] | KVVRFMSDASIYAFLSMEQAIADAGLSPEAY QNNPRVGLIAGSGGGSPRFQVFGADAMRGP RGLKAVGPYVVTKAMASGVSACLATPFKIH GVNYSISSACATSAHCIGNAVEQIQLGKQDIV FAGGGEELCWEMACEFDAMGALSTKYNDT PEKASRTYDAHRDGFVIAGGGGMVVVEELE HALARGAHIYAEIVGYGATSDGADMVAPSG EGAVRCMKMAMHGVDTPIDYLNSHGTSTPV GDVKELAAIREVFGDKSPAISATKAMTGHSL GAAGVQEAIYSLLMLEHGFIAPSINIEELDEQ AAGLNIVTETTDRELTTVMSNSFGFGGTNAT LVMRKLKD |
| SEQ ID NO: 134 | fabH | >gi\|16129054\|ref\|NP_ 415609.1\| 3-oxoacyl- [acyl-carrier-protein] synthase III [*Escherichia coli* str. K-12 substr. MG1655] | MYTKIIGTGSYLPEQVRTNADLEKMVDTSDE WIVTRTGIRERHIAAPNETVSTMGFEAATRAI EMAGIEKDQIGLIVVATTSATHAFPSAACQIQ SMLGIKGCPAFDVAAACAGFTYALSVADQY VKSGAVKYALVVGSDVLARTCDPTDRGTIII FGDGAGAAVLAASEEPGIISTHLHADGSYGE LLTLPNADRVNPENSIHLTMAGNEVPFKVAVT ELAHIVDETLAANNLDRSQLDWLVPHQANL RIISATAKKLGMSMDNVVVTLDRHGNTSAA SVPCALDEAVRDGRIKPGQLVLLEAFGGGFT WGSALVRF |
| SEQ ID NO: 135 | fabD | >gi\|16129055\|ref\|NP_ 415610.1\| malonyl- CoA-[acyl-carrier- protein]transacylase [*Escherichia coli* str. K-12 substr. MG1655] | MTQFAFVFPGQGSQTVGMLADMAASYPIVE ETFAEASAALGYDLWALTQQGPAEELNKTW QTQPALLTASVALYRVWQQQGGKAPAMMA GHSLGEYSALVCAGVIDFADAVRLVEMRGK FMQEAVPEGTGAMAAIIGLDDASIAKACEEA AEGQVVSPVNFNSPGQVVIAGHKEAVERAG AACKAAGAKRALPLPVSVPSHCALMKPAAD KLAVELAKITFNAPTVPVVNNVDVKCETNG DAIRDALVRQLYNPVQWTKSVEYMAAQGV EHLYEVGPGKVLTGLTKRIVDTLTASALNEP SAMAAALEL |
| SEQ ID NO: 136 | fabF | >gi\|16129058\|ref\|NP_ 415613.1\| 3-oxoacyl- [acyl-carrier-protein] synthase II [*Escherichia coli* str. K-12 substr. MG1655] | MSKRRVVVTGLGMLSPVGNTVESTWKALL AGQSGISLIDHFDTSAYATKFAGLVKDFNCE DIISRKEQRKMDAFIQYGIVAGVQAMQDSGL EITEENATRIGAAIGSGIGGLGLIEENHTSLMN GGPRKISPFFVPSTIVNMVAGHLTIMYGLRGP SISIATACTSGVHNIGHAARIIAYGDADVMV AGGAEKASTPLGVGGFGAARALSTRNDNPQ AASRPWDKERDGFVLGDGAGMLVLEEYEH AKKRGAKIYAELVGFGMSSDAYHMTSPPEN GAGAALAMANALRDAGIEASQIGYVNAHGT STPAGDKAEAQAVKTIFGEAASRVLVSSTKS MTGHLLGAAGAVESIYSILALRDQAVPPTIN LDNPDEGCDLDFVPHEARQVSGMEYTLCNS FGFGGTNGSLIFKKI |
| SEQ ID NO: 137 | fabG | >gi\|16129056\|ref\|NP_ 415611.1\| 3-oxoacyl- [acyl-carrier-protein] reductase [*Escherichia coli* str. K-12 substr. MG1655] | MNFEGKIALVTGASRGIGRAIAETLAARGAK VIGTATSENGAQAISDYLGANGKGLMLNVT DPASIESVLEKIRAEFGEVDILVNNAGITRDN LLMRMKDEEWNDIIETNLSSVFRLSKAVMR AMMKKRHGRIITIGSVVGTMGNGGQANYA AAKAGLIGFSKSLAREVASRGITVNVVAPGFI ETDMTRALSDDQRAGILAQVPAGRLGGAQE IANAVAFLASDEAAYITGETLHVNGGMYMV |
| SEQ ID NO: 138 | fabA | >gi\|16128921\|ref\|NP_ 415474.1\| beta- hydroxydecanoyl thioester dehydrase [*Escherichia coli* str. K-12 substr. MG1655] | MVDKRESYTKEDLLASGRGELFGAKGPQLP APNMLMMDRVVKMTETGGNFDKGYVEAEL DINPDLWFFGCHFIGDPVMPGCLGLDAMWQ LVGFYLGWLGGEGKGRALGVGEVKFTGQV LPTAKKVTYRIHFKRIVNRRLIMGLADGEVL VDGRLIYTASDLKVGLFQDTSAF |
| SEQ ID NO: 139 | fabZ | >gi\|16128173\|ref\|NP_ 414722.1\| (3R)- hydroxymyristol acyl carrier protein dehydratase [*Escherichia coli* str. K-12 substr. MG1655] | MTTNTHTLQIEEILELLPHRFPFLLVDRVLDF EEGRFLRAVKNVSVNEPFFQGHFPGKPIFPG VLILEAMAQATGILAFKSVGKLEPGELYYFA GIDEARFKRPVVPGDQMIMEVTFEKTRRGLT RFKGVALVDGKVVCEATMMCARSREA |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| SEQ ID NO: 140 | fabR | >gi\|145698338\|ref\|NP_418398.2\| DNA-binding transcriptional repressor [Escherichia coli str. K-12 substr. MG1655] | MGVRAQQKEKTRRSLVEAAFSQLSAERSFA SLSLREVAREAGIAPTSFYRHFRDVDELGLT MVDESGLMLRQLMRQARQRIAKGGSVIRTS VSTFMEFIGNNPNAFRLLLRERSGTSAAFRA AVAREIQHFIAELADYLELENHMPRAFTEAQ AEAMVTIVFSAGAEALDVGVEQRRQLEERL VLQLRMISKGAYYWYRREQEKTAIIPGNVK DE |
| SEQ ID NO: 141 | fabI | enoyl-ACP reductase, NADH-dependent, temperature-sensitive applicants allele | MGFLSGKRILVTGVASKLSIAYGIAQAMHRE GAELAFTYQNDKLKGRVEEFAAQLGSDIVL QCDVAEDASIDTMFAELGKVWPKFDGFVHS IGFAPGDQLDGDYVNAVTREGFKIAHDISSY SFVAMAKACRSMLNPGSALLTLSYLGAERAI PNYNVMGLAKASLEANVRYMANAMGPEGV RVNAISAGPIRTLAASGIKDFRKMLAHCEAV TPIRRTVTIEDVGNSAAFLCSDLSAGIFGEVV HVDGGFSIAAMNELELK |
| SEQ ID NO: 142 | fabB | 3-ketoacyl-ACP synthase I, temperature sensitive applicants allele | MKRAVITGLGIVSSIGNNQQEVLASLREGRS GITFSQELKDSGMRSHVWGNVKLDTTGLIDR KVVRFMSDASIYAFLSMEQAIADAGLSPEAY QNNPRVGLIAGSGGGSPRFQVFGADAMRGP RGLKAVGPYVVTKAMASGVSACLATPFKIH GVNYSISSACATSAHCIGNAVEQIQLGKQDIV FAGGGEELCWEMACEFDAMGALSTKYNDT PEKASRTYDAHRDGFVIAGGGGMVVVEELE HALARGAHIYAEIVGYGATSDGADMVAPSG EGAVRCMKMAMHGVDTPIDYLNSHGTSTPV GDVKELAAIREVFGDKSPAISATKVMTGHSL GAAGVQEAIYSLLMLEHGFIAPSINIEEELDEQ AAGLNIVTETTDRELTTVMSNSFGFGGTNAT LVMRKLKD |
| SEQ ID NO: 143 | fabD | malonyl-CoA: ACP transacylase, temperature sensitive applicants allele | MTQFAFVFPGQGSQTVGMLADMAASYPIVE ETFAEASAALGYDLWALTQQGPAEELNKTW QTQPALLTASVALYRVWQQQGGKAPAMMA GHSLGEYSALVCAGVIDFADAVRLVEMRGK FMQEAVPEGTGAMAAIIGLDDASIAKACEEA AEGQVVSPVNFNSPGQVVIAGHKEAVERAG AACKAAGAKRALPLPVSVPSHCALMKPAAD KLAVELAKITFNAPTVPVVNNVDVKCETNG DAIRDALVRQLYNPVQQTKSVEYMAAQGV EHLYEVGPGKVLTGLTKRIVDTLTASALNEP SAMAAAL |

Malonyl-CoA synthesis and other genes related to optimizing flux

| SEQ ID NO: 144 | udhA | >gi\|90111670\|ref\|NP_418397.2\| pyridine nucleotide transhydrogenase, soluble [Escherichia coli str. K-12 substr. MG1655] | MPHSYDYDAIVIGSGPGGEGAAMGLVKQGA RVAVIERYQNVGGGCTHWGTIPSKALRHAV SRIIEFNQNPLYSDHSRLLRSSFADILNHADN VINQQTRMRQGFYERNHCEILQGNARFVDE HTLALDCPDGSVETLTAEKFVIACGSRPYHP TDVDFTHPRIYDSDSILSMHHEPRHVLIYGAG VIGCEYASIFRGMDVKVDLINTRDRLLAFLD QEMSDSLSYHFWNSGVVIRHNEEYEKIEGCD DGVIMHLKSGKKLKADCLLYANGRTGNTDS LALQNIGLETDSRGQLKVNSMYQTAQPHVY AVGDVIGYPSLASAAYDQGRIAAQALVKGE ATAHLIEDIPTGIYTIPEISSVGKTEQQLTAMK VPYEVGRAQFKHLARAQIVGMNVGTLKILF HRETKEILGIHCFGERAAEIIHIGQAIMEQKG GGNTIEYFVNTTFNYPTMAEAYRVAALNGL NRLF |
| SEQ ID NO: 145 | pntA | >gi\|1612956\|ref\|NP_416120.1\| pyridine nucleotide transhydrogenase, alpha subunit [Escherichia coli str. K-12 substr. MG1655] | MRIGIPRERLTNETRVAATPKTVEQLLKLGFT VAVESGAGQLASFDDKAFVQAGAEIVEGNS VWQSEIILKVNAPLDDEIALLNPGTTLVSFIW PAQNPELMQKLAERNVTVMAMDSVPRISRA QSLDALSSMANIAGYRAIVEAAHEFGRFFTG QITAAGKVPPAKVMVIGAGVAGLAAIGAAN SLGAIVRAFDTRPEVKEQVQSMGAEFLELDF KEEEAGSGDGYAKVMSDAFIKAEMELFAAQA KEVDIIVTTALIPGKPAPKLITREMVDSMKAG |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | | SVIVDLAAQNGGNCEYTVPGEIFTTENGVKV IGYTDLPGRLPTQSSQLYGTNLVNLLKLLCK EKDGNITVDFDDVVIRGVTVIRAGEITWPAPP IQVSAQPQAAQKAAPEVKTEEKCTCSPWRK YALMALAIILFGWMASVAPKEFLGHFTVFAL ACVVGYYVVWNVSHALHTPLMSVTNAISGII VVGALLQIGQGGWVSFLSFIAVLIASINIFGG FTVTQRMLKMFRKN |
| SEQ ID NO: 146 | pntB | >gi\|16129560\|ref\|NP_ 416119.1\| pyridine nucleotide transhydrogenase, beta subunit [*Escherichia coli* str. K-12 substr. MG1655] | MSGGLVTAAYIVAAILFIFSLAGLSKHETSRQ GNNFGIAGMAIALIATIFGPDTGNVGWILLA MVIGGAIGIRLAKKVEMTEMPELVAILHSFV GLAAVLVGFNSYLHHDAGMAPILVNIHLTE VFLGIFIGAVTFTGSVVAFGKLCGKISSKPLM LPNRHKMNLAALVVSFLLLIVFVRTDSVGLQ VLALLIMTAIALVFGWHLVASIGGADMPVV VSMLNSYSGWAAAAAGFMLSNDLLIVTGAL VGSSGAILSYIMCKAMNRSFISVIAGGFGTDG SSTGDDQEVGEHREITAEETAELLKNSHSVII TPGYGMAVAQAQYPVAEITEKLRARGINVR FGIHPVAGRLPGHMNVLLAEAKVPYDIVLE MDEINDDFADTDTVLVIGANDTVNPAAQDD PKSPIAGMPVLEVWKAQNVIVFKRSMNTGY AGVQNPLFFKENTHMLFGDAKASVDAILKA L |
| SEQ ID NO: 147 | ACCase | >gi\|16128178\|ref\|NP_ 414727.1\| acetyl-CoA carboxylase, carboxytransferase, alpha subunit [*Escherichia coli* str. K-12 substr. MG1655] | MSLNFLDFEQPIAELEAKIDSLTAVSRQDEKL DINIDEEVHRLREKSVELTRKIFADLGAWQIA QLARHPQRPYTLDYVRLAFDEFDELAGDRA YADDKAIVGGIARLDGRPVMIIGHQKGRETK EKIRRNFGMPAPEGYRKALRLMQMAERFKM PIITFIDTPGAYPGVGAEERGQSEAIARNLRE MSRLGVPVVCTVIGEGGSSGALAIGVGDKV NMLQYSTYSVISPEGCASILWKSADKAPLAA EAMGIIAPRLKELKLIDSIIPEPLGGAHRNPEA MAASLKAQLLADLADLDVLSTEDLKNRRYQ RLMSYGYA |
| SEQ ID NO: 148 | ACCase | >gi\|16131143\|ref\|NP_ 417721.1\| acetyl CoA carboxylase, BCCP subunit [*Escherichia coli* str. K-12 substr. MG1655] | MDIRKIKKLIELVEESGISELEISEGEESVRISR AAPAASFPVMQQAYAAPMMQQPAQSNAAA PATVPSMEAPAAAEISGHIVRSPMVGTFYRT PSPDAKAFIEVGQKVNVGDTLCIVEAMKMM NQIEADKSGTVKAILVESGQPVEFDEPLVVIE |
| SEQ ID NO: 149 | ACCase | >gi\|16131144\|ref\|NP_ 417722.1\| acetyl-CoA carboxylase, biotin carboxylase subunit [*Escherichia coli* str. K-12 substr. MG1655] | MLDKIVIANRGEIALRILRACKELGIKTAVVH SSADRDLKHVLLADETVCIGPAPSVKSYLNIP AIISAAEITGAVAIHPGYGFLSENANFAEQVE RSGFIFIGPKAETIRLMGDKVSAIAAMKKAG VPCVPGSDGPLGDDMDKNRAIAKRIGYPVII KASGGGGRGMRVVRGDAELAQSISMTRAE AKAAFSNDMVYMEKYLENPRHVEIQVLAD GQGNAIYLAERDCSMQRRHQKVVEEAPAPG ITPELRRYIGERCAKACVDIGYRGAGTFEFLF ENGEFYFIEMNTRIQVEHPVTEMITGVDLIKE QLRIAAGQPLSIKQEEVHVRGHAVECRINAE DPNTFLPSPGKITRFHAPGGFGVRWESHIYA GYTVPPYYDSMIGKLICYGENRDVAIARMK NALQELIIDGIKTNVDLQIRIMNDENFQHGGT NIHYLEKKLGLQEK |
| SEQ ID NO: 150 | ACCase | >gi\|16130251\|ref\|NP_ 416819.1\| acetyl-CoA carboxylase, beta (carboxyltransferase) subunit [*Escherichia coli* str. K-12 substr. MG1655] | MSWIERIKSNITPTRKASIPEGVWTKCDSCGQ VLYRAELERNLEVCPKCDHHMRMTARNRL HSLLDEGSLVELGSELEPKDVLKFRDSKKYK DRLASAQKETGEKDALVVMKGTLYGMPVV AAAFEFAFMGGSMGSVVGARFVRAVEQALE DNCPLICFSASGGARMQEALMSLMQMAKTS AALAKMQERGLPYISVLTDPTMGGVSASFA MLGDLNIAEPKALIGFAGPRVIEQTVREKLPP GFQRSEFLIEKGAIDMIVRRPEMRLKLASILA KLMNLPAPNPEAPREGVVVPPVPDQEPEA |
| SEQ ID NO: 151 | PDH | >gi\|16128107\|ref\|NP_ 414656.1\| pyruvate dehydrogenase, | MSERFPNDVDPIETRDWLQAIESVIREEGVER AQYLIDQLLAEARKGGVNVAAGTGISNYINT IPVEEQPEYPGNLELERRIRSAIRWNAIMTVL |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | decarboxylase component E1, thiamin-binding [*Escherichia coli* str. K-12 substr. MG1655] | RASKKDLELGGHMASFQSSATIYDVCFNHFF RARNEQDGGDLVYFQGHISPGVYARAFLEG RLTGEQLDNFRQEVHGNGLSSYPHPKLMPEF WQFPTVSMGLGPIGAIYQAKFLKYLEHRGLK DTSKQTVYAFLGDGEMDEPESKGAITIATRE KLDNLVFVINCNLQRLDGPVTGNGKIINELE GIFEGAGWNVIKVMWGSRWDELLRKDTSG KLIQLMNETVDGDYQTFKSKDGAYVREHFF GKYPETAALVADWTDEQIWALNRGGHDPK KIYAAFKKAQETKGKATVILAHTIKGYGMG DAAEGKNIAHQVKKMNMDGVRHIRDRFNV PVSDADIEKLPYITFPEGSEEHTYLHAQRQKL HGYLPSRQPNFTEKLELPSLQDFGALLEEQS KEISTTIAFVRALNVMLKNKSIKDRLVPIIAD EARTFGMEGLFRQIGIYSPNGQQYTPQDREQ VAYYKEDEKGQILQEGINELGAGCSWLAAA TSYSTNNLPMIPFYIYYSMFGFQRIGDLCWA AGDQQARGFLIGGTSGRTTLNGEGLQHEDG HSHIQSLTIPNCISYDPAYAYEVAVIMHDGLE RMYGEKQENVYYYITTLNENYHMPAMPEG AEEGIRKGIYKLETIEGSKGKVQLLGSGSILR HVREAAEILAKDYGVGSDVYSTSFTELARD GQDCERWNMLHPLETPRVPYIAQVMNDAPA VASTDYMKLFAEQVRTYVPADDYRVLGTD GFGRSDSRENLRHHFEVDASYVVVAALGEL AKRGEIDKKVVADAIAKFNIDADKVNPRLA |
| SEQ ID NO: 152 | PDH | >gi\|16128108\|ref\|NP_414657.1\| pyruvate dehydrogenase, dihydrolipoyltransacetylase component E2 [*Escherichia coli* str. K-12 substr. MG1655] | MAIEIKVPDIGADEVEITEILVKVGDKVEAEQ SLITVEGDKASMEVPSPQAGIVKEIKVSVGD KTQTGALIMIFDSADGAADAAPAQAEEKKE AAPAAAPAAAAAKDVNVPDIGSDEVEVTEIL VKVGDKVEAEQSLITVEGDKASMEVPAPFA GTVKEIKVNVGDKVSTGSLIMVFEVAGEAG AAAAPAAKQEAAPAAAPAPAAGVKEVNVPDI GGDEVEVTEVMVKVGDKVAAEQSLITVEGD KASMEVPAPFAGVVKELKVNVGDKVKTGSL IMIFENEGAAPAAAPAKQEAAAPAPAAKAE APAAAPAAKAEGKSEFAENDAYVHATPLIR RLAREFGVNLAKVKGTGRKGRILREDVQAY VKEAIKRAEAAPAATGGGIPGMLPWPKVDF SKFGEIEEVELGRIQKISGANLSRNWVMIPHV THFDKTDITELEAFRKQQNEEAAKRKLDVKI TPVVFIMKAVAAALEQMPRFNSSLSEDGQRL TLKKYINIGVAVDTPNGLVVPVFKDVNKKGI IELSRELMTISKKARDGKLTAGEMQGGCFTIS SIGGLGTTHFAPIVNAPEVAILGVSKSAMEPV WNGKEFVPRLMLPISLSFDHRVIDGADGARF ITIINNTLSDIRRLVM |
| SEQ ID NO: 153 | PDH | >gi\|16128109\|ref\|NP_414658.1\| lipoamide dehydrogenase, E3 component is part of three enzyme complexes [*Escherichia coli* str. K-12 substr. MG1655] | MSTEIKTQVVVLGAGPAGYSAAFRCADLGL ETVIVERYNTLGGVCLNVGCIPSKALLHVAK VIEEAKALAEHGIVFGEPKTDIDKIRTWKEK VINQLTGGLAGMAKGRKVKVVNGLGKFTG ANTLEVEGENGKTVINFDNAIIAAGSRPIQLP FIPHEDPRIWDSTDALELKEVPERLLVMGGGI IGLEMGTVYHALGSQIDVVEMFDQVIPAAD KDIVKVFTKRISKKFNLMLETKVTAVEAKED GIYVTMEGKKAPAEPQRYDAVLVAIGRVPN GKNLDAGKAGVEVDDRGFIRVDKQLRTNVP HIFAIGDIVGQPMLAHKGVHEGHVAAEVIAG KKHYFDPKVIPSIAYTEPEVAWVGLTEKEAK EKGISYETATFPWAASGRAIASDCADGMTKL IFDKESHRVIGGAIVGTNGGELLGEIGLAIEM GCDAEDIALTIHAHPTLHESVGLAAEVFEGSI TDLPNPKAKKK |
| SEQ ID NO: 154 | coaA | >gi\|16131808\|ref\|NP_418405.1\| pantothenate kinase [*Escherichia coli* str. K-12 substr. MG1655] | MSIKEQTLMTPYLQFDRNQWAALRDSVPMT LSEDEIARLKGINEDLSLEEVAEIYLPLSRLLN FYISSNLRRQAVLEQFLGTNGQRIPYIISIAGS VAVGKSTTARVLQALLSRWPEHRRVELITTD GFLHPNQVLKERGLMKKKGFPESYDMHRLV KFVSDLKSGVPNVTAPVYSHLIYDVIPDGDK TVVQPDILILEGLNVLQSGMDYPHDPHHVFV SDFVDFSIYVDAPEDLLQTWYINRFLKFREG AFTDPDSYFHNYAKLTKEEAIKTAMTLWKEI |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | | NWLNLKQNILPTRERASLILTKSANHAVEEV RLRK |
| SEQ ID NO: 155 | panD | >gi\|16128124\|ref\|NP_414673.1\| aspartate 1-decarboxylase [Escherichia coli str. K-12 substr. MG1655] | MIRTMLQGKLHRVKVTHADLHYEGSCAIDQ DFLDAAGILENEAIDIWNVTNGKRFSTYAIA AERGSRIISVNGAAAHCASVGDIVIIASFVTM PDEEARTWRPNVAYFEGDNEMKRTAKAIPV QVA |
| SEQ ID NO: 156 | aceA | >gi\|16131841\|ref\|NP_418439.1\| isocitrate lyase [Escherichia coli str. K-12 substr. MG1655] | MKTRTQQIEELQKEWTQPRWEGITRPYSAED VVKLRGSVNPECTLAQLGAAKMWRLLHGE SKKGYINSLGALTGGQALQQAKAGIEAVYLS GWQVAADANLAASMYPDQSLYPANSVPAV VERINNTFRRADQIQWSAGIEPGDPRYVDYF LPIVADAEAGFGGVLNAFELMKAMIEAGAA AVHFEDQLASVKKCGHMGGKVLVPTQEAIQ KLVAARLAADVTGVPTLLVARTDADAADLI TSDCDPYDSEFITGERTSEGFFRTHAGIEQAIS RGLAYAPYADLVWCETSTPDLELARRFAQAI HAKYPGKLLAYNCSPSFNWQKNLDDKTIAS FQQQLSDMGYKFQFITLAGIHSMWFNMFDL ANAYAQGEGMKHYVEKVQQPEFAAAKDGY TFVSHQQEVGTGYFDKVTTIIQGGTSSVTAL TGSTEESQF |
| SEQ ID NO: 157 | aceB | >gi\|16131840\|ref\|NP_418438.1\| malate synthase A [Escherichia coli str. K-12 substr. MG1655] | MTEQATTTDELAFTRPYGEQEKQILTAEAVE FLTELVTHFTPQRNKLLAARIQQQQDIDNGT LPDFISETASIRDADWKIRGIPADLEDRRVEIT GPVERKMVINALNANVKVFMADFEDSLAPD WNKVIDGQINLRDAVNGTISYTNEAGKIYQL KPNPAVLICRVRGLHLPEKHVTWRGEAIPGS LFDFALYFFHNYQALLAKGSGPYFYLPKTQS WQEAAWWSEVFSYAEDRFNLPRGTIKATLLI ETLPAVFQMDEILHALRDHIVGLNCGRWDYI FSYIKTLKNYPDRVLPDRQAVTMDKPFLNA YSRLLIKTCHKRGAFAMGGMAAFIPSKDEEH NNQVLNKVKADKSLEANNGHDGTWIAHPG LADTAMAVFNDILGSRKNQLEVMREQDAPI TADQLLAPCDGERTEEGMRANIRVAVQYIE AWISGNGCVPIYGLMEDAATAEISRTSIWQW IHHQKTLSNGKPVTKALFRQMLGEEMKVIAS ELGEERFSQGRFDDAARLMEQITTSDELIDFL TLPGYRLLA |
| SEQ ID NO: 158 | aceK | >gi\|16131842\|ref\|NP_418440.1\| isocitrate dehydrogenase kinase/phosphatase [Escherichia coli str. K-12 substr. MG1655] | MPRGLELLIAQTILQGFDAQYGRFLEVTSGA QQRFEQADWHAVQQAMKNRIHLYDHHVGL VVEQLRCITNGQSTDAAFLLRVKEHYTRLLP DYPRFEIAESFFNSVYCRLFDHRSLTPERLFIF SSQPERRFRTIPRPLAKDFHPDHGWESLLMR VISDLPLRLRWQNKSRDIHYIIRHLTETLGTD NLAESHLQVANELFYRNKAAWLVGKLITPS GTLPFLLPIHQTDDGELFIDTCLTTTAEASIVF GFARSYFMVYAPLPAALVEWLREILPGKTTA ELYMAIGCQKHAKTESYREYLVYLQGCNEQ FIEAPGIRGMVMLVFTLPGFDRVFKVIKDRF APQKEMSAAHVRACYQLVKEHDRVGRMAD TQEFENPVLEKRHISPALMELLLQEAAEKITD LGEQIVIRHLYIERRMVPLNIWLEQVEGQQL RDAIEEYGNAIRQLAAANIFPGDMLFKNFGV TRHGRVVFYDYDEICYMTEVNFRDIPPPRYP EDELASEPWYSVSPGDVFPEEFRHWLCADPR IGPLFEEMHADLFRADYWRALQNRIREGHV EDVYAYRRRQRFSVRYGEMLF |
| SEQ ID NO: 159 | GAPDH | >gi\|16129733\|ref\|NP_416293.1\| glyceraldehyde-3-phosphate dehydrogenase A [Escherichia coli str. K-12 substr. MG1655] | MTIKVGINGFGRIGRIVFRAAQKRSDIEIVAIN DLLDADYMAYMLKYDSTHGRFDGTVEVKD GHLIVNGKKIRVTAERDPANLKWDEVGVDV VAEATGLFLTDETARKHITAGAKKVVMTGP SKDNTPMFVKGANFDKYAGQDIVSNASCTT NCLAPLAKVINDNFGIIEGLMTTVHATTATQ KTVDGPSHKDWRGGRGASQNIIPSSTGAAK AVGKVLPELNGKLTGMAFRVPTPNVSVVDL TVRLEKAATYEQIKAAVKAAAEGEMKGVL GYTEDDVVSTDFNGEVCTSVFDAKAGIALN DNFVKLVSWYDNETGYSNKVLDLIAHISK |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| SEQ ID NO: 160 | pyk | >gi\|16129807\|ref\|NP_416368.1\| pyruvate kinase II [Escherichia coli str. K-12 substr. MG1655] | MSRRLRRTKIVTTLGPATDRDNNLEKVIAAG ANVVRMNFSHGSPEDHKMRADKVREIAAKL GRHVAILGDLQGPKIRVSTFKEGKVFLNIGD KFLLDANLGKGEGDKEKVGIDYKGLPADVV PGDILLLDDGRVQLKVLEVQGMKVFTEVTV GGPLSNNKGINKLGGGLSAEALTEKDKADIK TAALIGVDYLAVSFPRCGEDLNYARRLARD AGCDAKIVAKVERAEAVCSQDAMDDIILAS DVVMVARGDLGVEIGDPELVGIQKALIRRAR QLNRAVITATQMMESMITNPMPTRAEVMDV ANAVLDGTDAVMLSAETAAGQYPSETVAA MARVCLGAEKIPSINVSKHRLDVQFDNVEEA IAMSAMYAANHLKGVTAIITMTESGRTALM TSRISSGLPIFAMSRHERTLNLTALYRGVTPV HIDSANDGVAAASEAVNLLRDKGYLMSGD LVIVTQGDVMSTVGSTNTTRILTVE |
| SEQ ID NO: 161 | pyk | >gi\|16129632\|ref\|NP_416191.1\| pyruvate kinase I [Escherichia coli str. K-12 substr. MG1655] | MKKTKIVCTIGPKTESEEMLAKMLDAGMNV MRLNFSHGDYAEHGVRIQNLRNVMSKTGKT AAILLDTKGPEIRTMKLEGGNDVSLKAGQTF TFTTDKSVIGNSEMVAVTYEGFTTDLSVGNT VLVDDGLIGMEVTAIEGNKVICKVLNNGDL GENKGVNLPGVSIALPALAEKDKQDLIFGCE QGVDFVAASFIRKRSDVIEIREHLKAHGGENI HIISKIENQEGLNNFDEILEASDGIMVARGDL GVEIPVEEVIFAQKMMIEKCIRARKVVITATQ MLDSMIKNPRPTRAEAGDVANAILDGTDAV MLSGESAKGKYPLEAVSIMATICERTDRVM NSRLEFNNDNRKLRITEAVCRGAVETAEKLD APLIVVATQGGKSARAVRKYFPDATILALTT NEKTAHQLVLSKGVVPQLVKEITSTDDFYRL GKELALQSGLAHKGDVVVMVSGALVPSGTT NTASVHVL |
| SEQ ID NO: 162 | gltA | >gi\|16128695\|ref\|NP_415248.1\| citrate synthase [Escherichia coli str. K-12 substr. MG1655] | MADTKAKLTLNGDTAVELDVLKGTLGQDVI DIRTLGSKGVFTFDPGFTSTASCESKITFIDGD EGILLHRGFPIDQLATDSNYLEVCYILLNGEK PTQEQYDEFKTTVTRHTMIHEQITRLFHAFR RDSHPMAVMCGITGALAAFYHDSLDVNNPR HREIAAFRLLSKMPTMAAMCYKYSIGQPFV YPRNDLSYAGNFLNMMFSTPCEPYEVNPILE RAMDRILILHADHEQNASTSTVRTAGSSGAN PFACIAAGIASLWGPAHGGANEAALKMLEEI SSVKHIPEFVRRAKDKNDSFRLMGFGHRVY KNYDPRATVMRETCHEVLKELGTKDDLLEV AMELENIALNDPYFIEKKLYPNVDFYSGIILK AMGIPSSMFTVIFAMARTVGWIAHWSEMHS DGMKIARPRQLYTGYEKRDFKSDIKR |
| SEQ ID NO: 163 | bicA | >gi\|109820126\|gb\|ABG46427.1\| BicA [Synechococcus sp. PCC 70021 | MQITNKIHFRNIRGDIFGGLTAAVIALPMALA FGVASGAGAEAGLWGAVLVGFFAALFGGTP TLISEPTGPMTVVMTAVIAHFTASAATPEEGL AIAFTVVMMAGVFQIIFGSLKLGKYVTMMP YTVISGPMSGIGIILVILQLAPFLGQASPGGGV IGTLQNLPTLLSNIQPGETALALGTVAIIWFM PEKFKKVIPPQLVALVLGTVIAFIVFPPEVSD LRRIGEIRAGFPELVRPSFSPVEFQRMILDAA VGMLGCIDALLTSVVADSLTRTEHNSNKEL IGQGLGNLFSGLFGGIAGAGATMGTVVNIQS GGRTALSGLVRAFVLLVVILGAASLTATIPLA VLAGIAFKVGVDIIDWSFLKRAHEISPKGALI MYGVILLTVLVDLIVAVGVGFVANVLTIER MSNLQSEKVQTVSDADDNIRLTTTEKRWLD EGQGRVLLFQLSGPMIFGVAKAIAREHNAM GDCDALVFDIGEVPHMGVTASLALENAIEEA LDKERQVYIVGAAGQTRRRLEKLKLFKRVPP DKCLMSREEALKNAVLGIYPHLADGVTAPSS EMG |
| SEQ ID NO: 164 | GOGAT | >gi\|308209621\|ref\|NP_417679.2\| glutamate synthase, large subunit [Escherichia coli str. K-12 substr. MG1655] | MLYDKSLERDNCFGLIAHIEGEPSHKVVRTAIHALA RMQHRGAILADGKTGDCGLLLQKPDRFFRIVAQER GWRLAKNYAVGMLFLNKDPELAAAARRIVEEELQRE TLSIVGWRDVPTNEGVLGEIALSSLPRIEQIFVNAPAG WRPRDMERRLFIARRRIEKRLEADKDFYVCSLSNLVNI |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | | YKGLCMPTDLPRFYLDLADLRLESAICLFHQRFSTNTV PRWPLAQPFRYLAHNGEINTITGNRQWARARTYKFQT PLIPDLHDAAPFVNETGSDSSSMDNMLELLLAGGMDII RAMRLLVPPAWQNNPDMDPELRAFFDFNSMHMEPW DGPAGIVMSDGRFAACNLDRNGLRPARYVITKDKLIT CASEVGIWDYQPDEVVEKGRVGPGELMVIDTRSGRIL HSAETDDDLKSRHPYKEWMEKNVRRLVPFEDLPDEE VGSRELDDDTLASYQKQFNYSAEELDSVIRVLGENGQ EAVGSMGDDTPFAVLSSQPRIIYDYFRQQFAQVTNPPI DPLREAHVMSLATSIGREMNVFCEAEGQAHRLSFKSPI LLYSDFKQLTTMKEEHYRADTLDITFDVTKTTLEATV KELCDKAEKMVRSGTVLLVLSDRNIAKDRLPVPAPM AVGAIQTRLVDQSLRCDANIIVETASARDPHHFAVLL GFGATAIYPYLAYETLGRLVDTHAIAKDYRTVMLNY RNGINKGLYKIMSKMGISTIASYRCSKLFEAVGLHDD VVGLCFQGAVSRIGGASFEDFQQDLLNLSKRAWLAR KPISQGGLLKYVHGGEYHAYNPDVVRTLQQAVQSGE YSDYQEYAKLVNERPATTLRDLLAITPGENAVNIADV EPASELFKRFDTAAMSIGALSPEAHEALAEAMNSIGG NSNSGEGGEDPARYGTNKVSRIKQVASGRFGVTPAYL VNADVIQIKVAQGAKPGEGGQLPGDKVTPYIAKLRYS VPGVTLISPPPHHDIYSIEDLAQLIFDLKQVNPKAMISV KLVSEPGVGTIATGVAKAYADLITIAGYDGGTGASPLS SVKYAGCPWELGLVETQQALVANGLRHKIRLQVDGG LKTGVDIIKAAILGAESFGFGTGPMVALGCKYLRICHL NNCATGVATQDDKLRKNHYHGLPFKVTNYFEFIARE TRELMAQLGVTRLVDLIGRTDLLKELDGFTAKQQKL ALSKLLETAEPHPGKALYCTENNPPPFDNGLLNAQLLQ QAKPFVDERQSKTFWFDIRNTDRSVGASLSGYIAQTH GDQGLAADPIKAYFNGTAGQSPGVWNAGGVELYLTG DANDYVGKGMAGGLIAIRPPVGSAFRSHEASIIGNTCL YGATGGRLYAAGRAGERFGVRNSGAITVVEGIGDNG CEYMTGGIVCILGKTGVNFGAGMTGGFAYVLDESGD FRKRVNPELVEVLSVDALAIHEEHLRGLITEHVQHTGS QRGEEILANWSTFATKFALVKPKSSDVKALLGHRSRS AAELRVQAQ |
| SEQ ID NO: 165 | GOGAT | >gi\|16131103\|ref\|NP_ 417680.1\| glutamate synthase, 4Fe-4S protein, small subunit [Escherichia coli str. K-12 substr. MG1655] | MSQNVYQFIDLQRVDPPKKPLKIRKIEFVEIY EPFSEGQAKAQADRCLSCGNPYCEWKCPVH NYIPNWLKLANEGRIFEAAELSHQTNTLPEV CGRVCPQDRLCEGSCTLNDEFGAVTIGNIER YINDKAFEMGWRPDMSGVKQTGKKVAIIGA GPAGLACADVLTRNGVKAVVFDRHPEIGGL LTFGIPAFKLEKEVMTRRREIFTGMGIEFKLN TEVGRDVQLDDLLSDYDAVFLGVGTYQSMR GGLENEDADGVYAALPFLIANTKQLMGFGE TRDEPFVSMEGKRVVVLGGGDTAMDCVRTS VRQGAKHVTCAYRRDEENMPGSRREVKNA REEGVEFKFNVQPLGIEVNGNGKVSGVKMV RTEMGEPDAKGRRRAEIVAGSEHIVPADAVI MAFGFRPHNMEWLAKHSVELDSQGRIIAPE GSDNAFQTSNPKIFAGGDIVRGSDLVVTAIAE GRKAADGIMNWLEV |
| SEQ ID NO: 166 | gdh | >gi\|16129715\|ref\|NP_ 416275.1\| glutamate dehydrogenase, NADP-specific [Escherichia coli str. K-12 substr. MG1655] | MDQTYSLESFLNHVQKRDPNQTEFAQAVRE VMTTLWPFLEQNPKYRQMSLLERLVEPERVI QIRVVWVDDRNQIQVNRAWRVQFSSAIGPY KGGMRFHPSVNLSILKFLGFEQTFKNALTTL PMGGGKGGSDFDPKGKSEGEVMRFCQALM TELYRHLGADTDVPAGDIGVGGREVGFMAG MMKKLSNNTACVFTGKGLSFGGSLIRPEATG YGLVYFTEAMLKRHGMGFEGMRVSVSGSG NVAQYAIEKAMEFGARVITASDSSGTVVDES GFTKEKLARLIEIKASRDGRVADYAKEFGLV YLEGQQPWSLPVDIALPCATQNELDVDAAH QLIANGVKAVAEGANMPTTIEATELFQQAG VLFAPGKAANAGGVATSGLEMAQNAARLG WKAEKVDARLHHIMLDIHHACVEHGGEGE QTNYVQGANIAGFVKVADMLAQGVI |
| SEQ ID NO: 167 | can | >gi\|16128119\|ref\|NP_ 414668.1\| carbonic anhydrase [Escherichia coli str. K-12 substr. MG1655] | MKDIDTLISNNALWSKMLVEEDPGFFEKLAQ AQKPRFLWIGCSDSRVPAERLTGLEPGELFV HRNVANLVIHTDLNCLSVVQYAVDVLEVEH IIICGHYGCGGVQAAVENPELGLINNWLLHIR DIWFKHSSLLGEMPQERRLDTLCELNVMEQ |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | | VYNLGHSTIMQSAWKRGQKVTIHGWAYGIH DGLLRDLDVTATNRETLEQRYRHGISNLKLK HANHK |
| SEQ ID NO: 168 | cynT | >gi\|16128324\|ref\|NP_ 414873.1\| carbonic anhydrase [Escherichia coli str. K-12 substr. MG1655] | MKEIIDGFLKFQREAFPKREALFKQLATQQSP RTLFISCSDSRLVPELVTQREPGDLFVIRNAG NIVPSYGPEPGGVSASVEYAVAALRVSDIVIC GHSNCGAMTAIASCQCMDHMPAVSHWLRY ADSARVVNEARPHSDLPSKAAAMVRENVIA QLANLQTHPSVRLALEEGRIALHGWVYDIES GSIAAFDGATRQFVPLAANPRVCAIPLRQPT AA |
| SEQ ID NO: 169 | cynS | >gi\|16128325\|ref\|NP_ 414874.1\| cyanate aminohydrolase [Escherichia coli str. K-12 substr. MG1655] | MIQSQINRNIRLDLADAILLSKAKKDLSFAEI ADGTGLAEAFVTAALLGQQALPADAARLVG AKLDLDEDSILLLQMIPLRGCIDDRIPTDPTM YRFYEMLQVYGTTLKALVHEKFGDGIISAIN FKLDVKKVADPEGGERAVITLDGKYLPTKPF |
| SEQ ID NO: 170 | yibD | >gi\|16131486\|ref\|NP_ 418072.1\| putative glycosyl transferase [Escherichia coli str. K-12 substr. MG1655] | MMNSTNKLSVIIPLYNAGDDFRTCMESLITQ TWTALEIIIINDGSTDNSVEIAKYYAENYPHV RLLHQANAGASVARNRGIEVATGKYVAFVD ADDEVYPTMYETLMTMALEDDLDVAQCNA DWCFRETGETWQSIPTDRLRSTGVLTGPDW LRMGLSSRRWTHVVWMGVYRRDVIVKNNI KFIAGLHHQDIVWTTEFMFNALRARYTEQSL YKYYLHNTSVSRLHRQGNKNLNYQRHYIKI TRLLEKLNRNYADKIMIYPEFHQQITYEALR VCHAVRKEPDILTRQRMIAEIFTSGMYKRLIT NVRSVKVGYQALLWSFRLWQWRDKTRSHH RITRSAFNLR |
| SEQ ID NO: 171 | pstS | >gi\|16131597\|ref\|NP_ 418185.1\| L- glutamine: D-fructose- 6-phosphate aminotransferase [Escherichia coli str. K-12 substr. MG1655] | MCGIVGAIAQRDVAEILLEGLRRLEYRGYDS AGLAVVDAEGHMTRLRRLGKVQMLAQAAE EHPLHGGTGIAHTRWATHGEPSEVNAHPHV SEHIVVVHNGIIENHEPLREELKARGYTFVSE TDTEVIAHLVNWELKQGGTLREAVLRAIPQL RGAYGTVIMDSRHPDTLLAARSGSPLVIGLG MGENFIASDQLALLPVTRRFIFPLEEGDIAEITR RSVNIFDKTGAEVKRQDIESNLQYDAGDKGI YRHYMQKEIYEQPNAIKNTLTGRISHGQVDL SELGPNADELLSKVEHIQILACGTSYNSGMV SRYWFESLAGIPCDVEIASEFRYRKSAVRRNS LMITLSQSGETADTLAGLRLSKELGYLGSLAI CNVPGSSLVRESDLALMTNAGTEIGVASTKA FTTQLTVLLMLVAKLSRLKGLDASIEHDIVH GLQALPSRIEQMLSQDKRIEALAEDFSDKHH ALFLGRGDQYPIALEGALKLKEISYIHAEAY AAGELKHGPLALIDADMPVIVVAPNNELLEK LKSNIEEVRARGGQLYVFADQDAGFVSSDN MHIIEMPHVEEVIAPIFYTVPLQLLAYHVALI KGTDVDQPRNLAKSVTVE |
| SEQ ID NO: 172 | PDH | lipoamide dehydrogenase, NADH-inhibition resistant | MSTEIKTQVVVLGAGPAGYSAAFRCADLGL ETVIVERYNTLGGVCLNVGCIPSKALLHVAK VIEEAKALAEHGIVFGEPKTDIDKIRTWKEK VINQLTGGLAGMAKGRKVKVVNGLGKFTG ANTLEVEGENGKTVINFDNAIIAAGSRPIQLP FIPHEDPRIWDSTDALELKEVPERLLVMGGGI IGLEMGTVYHALGSQIDVVEMFDQVIPAAD KDIVKVFTKRISKKFNLMLETKVTAVEAKED GIYVTMEGKKAPAEPQRYDAVLVAIGRVPN GKNLDAGKAGVEVDDRGFIRVDKQLRTNVP HIFAIGDIVGQPMLAHKGVHEGHVAAEVIAG KKHYFDPKVIPSIAYTEPEVAWVGLTEKEAK EKGISYETATFPWAASGRAIASDCADGMTKL IFDKESHRVIGGAIVGTNGGELLGEIGLAIEM GCDAEDIALTIHAHPTLHESVGLAAEVFEGSI TDLPNPKAKKK |
| SEQ ID NO: 173 | coaA | pantothenate kinase, feedback-resistant | MSIKEQTLMTPYLQFDRNQWAALRDSVPMT LSEDEIARLKGINEDLSLEEVAEIYLPLSRLLN FYISSNLRRQAVLEQFLGTNGQRIPYIISIAGS VAVGKSTTAAVLQALLSRWPEHRRVELITTD GFLHPNQVLKERGLMKKKGFPESYDMHRLV |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | | KFVSDLKSGVPNVTAPVYSHLIYDVIPDGDK TVVQPDILILEGLNVLQSGMDYPHDPHHVFV SDFVDFSIYVDAPEDLLQTWYINRFLKFREG AFTDPDSYFHNYAKLTKEEAIKTAMTLWKEI NWLNLKQNILPTRERASLILTKSANHAVEEV RLRK |

Sugar transport and utilization

| SEQ ID NO | Enzyme | FASTA Header | Protein Sequence - NCBI Database |
|---|---|---|---|
| SEQ ID NO: 174 | cscA | >gi\|608708\|emb\|CAA 57219.1\| sucrose hydrolase [*Escherichia coli*] | MTQSRLHAAQNALAKLHERRGNTFYPHFHL APPAGWMNDPNGLIWFNDRYHAFYQHHPM SEHWGPMHWGHATSDDMIHWQHEPIALAP GDENDKDGCFSGSAVDDNGVLSLIYTGHVW LDGAGNDDAIREVQCLATSRDGIHFEKQGVI LTPPEGIMHFRDPKVWREADTWWMVVGAK DPGNTGQILLYRGSSLREWTFDRVLAHADA GESYMWECPDFFSLGDQHYLMFSPQGMNAE GYSYRNRFQSGVIPGMWSPGRLFAQSGHFTE LDNGHDFYAPQSFVAKDGRRIVIGWMDMW ESPMPSKREGWAGCMTLARELSESNGKLLQ RPVHEAESLRQQHQSISPRTISNKYVLQENA QAVEIQLQWALKNSDAEHYGLQLGAGMRL YIDNQSERLVLWRYYPHENLDGYRSIPLPQG DMLALRIFIDTSSVEVFINDGEAVMSSRIYPQ PEERELSLYASHGVAVLQHGALWQLG |
| SEQ ID NO: 175 | cscB | >gi\|608706\|emb\|CAA 57217.1\| sucrose permease [*Escherichia coli*] | MALNIPFRNAYYRFASSYSFLFFISWSLWWS LYAIWLKGHLGLTGTELGTLYSVNQFTSILF MMFYGIVQDKLGLKKPLIWCMSFILVLTGPF MIYVYEPLLQSNFSVGLILGALFFGLGYLAG CGLLDSFTEKMARNFHFEYGTARAWGSFGY AIGAFFAGIFFSISPHINFWLVSLFGAVFMMIN MRFKDKDHQCIAADAGGVKKEDFIAVFKDR NFWVFVIFIVGTWSFYNIFDQQLFPVFYAGLF ESHDVGTRLYGYLNSFQVVLEALCMAIIPFF VNRVGPKNALLIGVVIMALRILSCALFVNPW IISLVKLLHAIEVPLCVISVFKYSVANFDKRLS STIFLIGFQIASSLGIVLLSTPTGILFDHAGYQT VFFAISGIVCLMLLFGIFFLSKKREQIVMETPV PSAI |
| SEQ ID NO: 176 | cscK | >gi\|20451632\|emb\|CA A57218.2\| D-fructokinase [*Escherichia coli*] | MSAKVWVLGDAVVDLLPESDGRLLPCPGGA PANVAVGIARLGGTSGFIGRVGDDPFGALM QRTLLTEGVDITYLKQDEWHRTSTVLVDLN DQGERSFTFMVRPSADLFLETTDLPCWRHGE WLHLCSIALSAEPSRTSAFTAMTAIRHAGGF VSFDPNIREDLWQDEHLLRLCRQALQLAD VVKLSEEEWRLISGKTQNDRDICALAKEYEI AMLLVTKGAEGVVVCYRGQVHHFAGMSVN CVDSTGAGDAFVAGLLTGLSSTGLSTDERE MRRIIDLAQRCGALAVTAKGAMTALPCRQE LESEK |
| SEQ ID NO: 177 | galP | >gi\|16130844\|ref\|NP_ 417418.1\| D-galactose transporter [*Escherichia coli* str. K-12 substr. MG1655] | MPDAKKQGRSNKAMTFFVCFLAALAGLLFG LDIGVIAGALPFIADEFQITSHTQEWVVSSMM FGAAVGAVGSGWLSFKLGRKKSLMIGAILF VAGSLFSAAAPNVEVLILSRVLLGLAVGVAS YTAPLYLSEIAPEKIRGSMISMYQLMITIGILG AYLSDTAFSYTGAWRWMLGVIIPAILLLIGV FFLPDSPRWFAAKRRFVDAERVLLRLRDTSA EAKRELDEIRESLQVKQSGWALFKENSNFRR AVFLGVLLQVMQQFTGMNVIMYYAPKIFEL AGYTNTTEQMWGTIVGLTNVLATFIAIGLV DRWGRKPTLTLGFLVMAAGMGVLGTMMHI GIHSPSAQYFAIAMLLMFIVGFAMSAGPLIW VLCSEIQPLKGRDFGITCSTATNWIANMIVGA TFLTMLNTLGNANTFWVYAALNVLFILLTL WLVPETKHVSLEHIERNLMKGRKLREIGAH D |
| SEQ ID NO: 178 | galK | >gi\|16128725\|ref\|NP_ 415278.1\| galactokinase [*Escherichia coli* str. K-12 substr. MG1655] | MSLKEKTQSLFANAFGYPATHTIQAPGRVNL IGEHTDYNDGFVLPCAIDYQTVISCAPRDDR KVRVMAADYENQLDEFSLDAPIVAHENYQ WANYVRGVVKHLQLRNNSFGGVDMVISGN VPQGAGLSSSASLEVAVGTVLQQLYHLPLD |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | | GAQIALNGQEAENQFVGCNCGIMDQLISALG KKDHALLIDCRSLGTKAVSMPKGVAVVIINS NFKRTLVGSEYNTRREQCETGARFFQQPALR DVTIEEFNAVAHELDPIVAKRVRHILTENART VEAASALEQGDLKRMGELMAESHASMRDD FEITVPQIDTLVEIVKAVIGDKGGVRMTGGG FGGCIVALIPEELVPAVQQAVAEQYEAKTGI KETFYVCKPSQGAGQC |
| SEQ ID NO: 179 | cscB | sucrose permease mutant with increased activity | MALNIPFRNAYYRFASSYSFLFFISWSLWWS LYAIWLKGHLGLTGTELGTLYSVNQFTSILF MMFYGIVQDKLGLKKPLIWCMSFILVLTGPF MIYVYEPLLQSNFSVGLILGALFFGLGYLAG CGLLDSFTEKMARNFHFEYGTARAWGSFGY AIGAFFAGIFFSISPHINFWLVSLFGAVFMMIN MRFKDKDHQCIAADAGGVKKEDFIAVFKDR NFWVFVIFIVGTWSFYDIFDQQLFPVFYAGLF ESHDVGTRLYGYLNSFQVVLEALCMAIIPFF VNRVGPKNALLIGVVIMALRILSCALFVNPW VISLVKLLHAIEVPLCVISVFKYSVANFDKRL SSTIFLIGFQIASSLGIVLLSTPTGILFDHAGYQ TVFFAISGIVCLMLLFGIFFLSKKREQIVMETP VPSAI |

Host modifications for fatty acid production

| SEQ ID NO | Enzyme | FASTA Header | Protein Sequence - NCBI Database |
|---|---|---|---|
| SEQ ID NO: 180 | fadE | >gi\|90111100\|ref\|NP_414756.2\| acyl coenzyme A dehydrogenase [Escherichia coli str. K-12 substr. MG1655] | MMILSILATVVLLGALFYHRVSLFISSLILLA WTAALGVAGLWSAWVLVPLAIILVPPNFAP MRKSMISAPVFRGFRKVMPPMSRTEKEAIDA GTTWWEGDLFQGKPDWKKLHNYPQPRLTA EEQAFLDGPVEEACRMANDFQITHELADLPP ELWAYLKEHRFFAMIIKKEYGGLEFSAYAQS RVLQKLSGVSGILAITVGVPNSLGPGELLQH YGTDEQKDHYLPRLARGQEIPCFALTSPEAG SDAGAIPDTGIVCMGEWQGQQVLGMRLTW NKRYITLAPIATVLGLAFKLSDPEKLLGGAE DLGITCALIPTTTPGVEIGRRHFPLNVPFQNGP TRGKDVFVPIDYIIGGPKMAGQGWRMLVEC LSVGRGITLPSNSTGGVKSVALATGAYAHIR RQFKISIGKMEGIEEPLARIAGNAYVMDAAA SLITYGIMLGEKPAVLSAIVKYHCTHRGQQSI IDAMDITGGKGIMLGQSNFLARAYQGAPIAI TVEGANILTRSMMIFGQGAIRCHPYVLEEME AAKNNDVNAFDKLLFKIHGHVGSNKVRSFW LGLTRGLTSSTPTGDATKRYYQHLNRLSANL ALLSDVSMAVLGGSLKRRERISARLGDILSQ LYLASAVLKRYDDEGRNEADLPLVHWGVQ DALYQAEQAMDDLLQNFPNRVVAGLLNVVI FPTGRHYLAPSDKLDHKVAKILQVPNATRSR IGRGQYLTPSEHNPVGLLEEALVDVIAADPIH QRICKELGKNLPFTRLDELAHNALVKGLIDK DEAAILVKAEESRLRSINVDDFDPEELATKPV KLPEKVRKVEAA |
| SEQ ID NO: 181 | fadD | >gi\|16129759\|ref\|NP_416319.1\| acyl-CoA synthetase (long-chain-fatty-acid-CoA ligase)[Escherichia coli str. K-12 substr. MG1655] | MKKVWLNRYPADVPTEINPDRYQSLVDMFE QSVARYADQPAFVNMGEVMTFRKLEERSRA FAAYLQQGLGLKKGDRVALMMPNLLQYPV ALFGILRAGMIVVNVNPLYTPRELEHQLNDS GASAIVIVSNFAHTLEKVVDKTAVQHVILTR MGDQLSTAKGTVVNFVVKYIKRLVPKYHLP DAISFRSALHNGYRMQYVKPELVPEDLAFLQ YTGGTTGVAKGAMLTHRNMLANLEQVNAT YGPLLHPGKELVVTALPLYHIFALTINCLLFIE LGGQNLLITNPRDIPGLVKELAKYPFTAITGV NTLFNALLNNKEFQQLDFSSLHLSAGGGMP VQQVVAERWVKLTGQYLLEGYGLTECAPL VSVNPYDIDYHSGSIGLPVPSTEAKLVDDDD NEVPPGQPGELCVKGPQVMLGYWQRPDAT DEIIKNGWLHTGDIAVMDEEGFLRIVDRKKD MILVSGFNVYPNEIEDVVMQHPGVQEVAAV GYPSGSSGEAVKIFVVKKDPSLTEESLVTFCR RQLTGYKVPKLVEFRDELPKSNVGKILRREL RDEARGKVDNKA |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| SEQ ID NO: 182 | fadA | >gi\|49176430\|ref\|YP_026272.1\| 3-ketoacyl-CoA thiolase (thiolase I)[Escherichia coli str. K-12 substr. MG1655] | MEQVVIVDAIRTPMGRSKGGAFRNVRAEDL SAHLMRSLLARNPALEAAALDDIYWGCVQQ TLEQGFNIARNAALLAEVPHSVPAVTVNRLC GSSMQALHDAARMIMTGDAQACLVGGVEH MGHVPMSHGVDFHPGLSRNVAKAAGMMG LTAEMLARMHGISREMQDAFAARSHARAW AATQSAAFKNEIIPTGGHDADGVLKQFNYDE VIRPETTVEALATLRPAFDPVNGMVTAGTSS ALSDGAAAMLVMSESRAHELGLKPRARVRS MAVVGCDPSIMGYGPVPASKLALKKAGLSA SDIGVFEMNEAFAAQILPCIKDLGLIEQIDEKI NLNGGAIALGHPLGCSGARISTTLLNLMERK DVQFGLATMCIGLGQGIATVFERV |
| SEQ ID NO: 183 | fadB | >gi\|16131692\|ref\|NP_418288.1\| fused 3-hydroxybutyryl-CoA epimerase/delta(3)-cis-delta(2)-trans-enoyl-CoA isomerase/enoyl-CoA hydratase/3-hydroxyacyl-CoA dehydrogenase [Escherichia coli str. K-12 substr. MG1655] | MLYKGDTLYLDWLEDGIAELVFDAPGSVNK LDTATVASLGEAIGVLEQQSDLKGLLLRSNK AAFIVGADITEFLSLFLVPEEQLSQWLHFANS VFNRLEDLPVPTIAAVNGYALGGGCECVLAT DYRLATPDLRIGLPETKLGIMPGFGGSVRMP RMLGADSALEIIAAGKDVGADQALKIGLVD GVVKAEKLVEGAKAVLRQAINGDLDWKAK RQPKLEPLKLSKIEATMSFTIAKGMVAQTAG KHYPAPITAVKTIEAAARFGREEEALNLENKS FVPLAHTNEARALVGIFLNDQYVKGKAKKL TKDVETPKQAAVLGAGIMGGGIAYQSAWK GVPVVMKDINDKSLTLGMTEAAKLLNKQLE RGKIDGLKLAGVISTIHPTLDYAGFDRVDIVV EAVVENPKVKKAVLAETEQKVRQDTVLASN TSTIPISELANALERPENFCGMHFFNPVHRMP LVEIIRGEKSSDETIAKVVAWASKMGKTPIV VNDCPGFFVNRVLFPYFAGFSQLLRDGADFR KIDKVMEKQFGWPMGPAYLLDVVGIDTAH HAQAVMAAGFPQRMQKDYRDAIDALFDAN RFGQKNGLGFWRYKEDSKGKPKKEEDAAV EDLLAEVSQPKRDFSEEEIIARMMIPMVNEV VRCLEEGIIATPAEADMALVYGLGFPPFHGG AFRWLDTLGSAKYLDMAQQYQHLGPLYEV PEGLRNKARHNEPYYPPVEPARPVGDLKTA |
| SEQ ID NO: 184 | fadI | >gi\|16130275\|ref\|NP_416844.1\| beta-ketoacyl-CoA thiolase, anaerobic, subunit [Escherichia coli str. K-12 substr. MG1655] | MGQVLPLVTRQGDRIAIVSGLRTPFARQATA FHGIPAVDLGKMVVGELLARSEIPAEVIEQL VFGQVVQMPEAPNIAREIVLGTGMNVHTDA YSVSRACATSFQAVANVAESLMAGTIRAGIA GGADSSSVLPIGVSKKLARVLVDVNKARTM SQRLKLFSRLRLRDLMPVPPAVAEYSTGLRM GDTAEQMAKTYGITREQQDALAHRSHQRAA QAWSDGKLKEEVMTAFIPPYKQPLVEDNNIR GNSSLADYAKLRPAFDRKHGTVTAANSTPL TDGAAAVILMTESRAKELGLVPLGYLRSYAF TAIDVWQDMLLGPAWSTPLALERAGLTMSD LTLIDMHEAFAAQTLANIQLLGSERFAREAL GRAHATGEVDDSKFNVLGGSIAYGHPFAAT GARMITQTLHELRRRGGGFGLVTACAAGGL GAAMVLEAE |
| SEQ ID NO: 185 | fadJ | >gi\|16130274\|ref\|NP_416843.1\| fused enoyl-CoA hydratase and epimerase and isomerase/3-hydroxyacyl-CoA dehydrogenase [Escherichia coli str. K-12 substr. MG1655] | MEMTSAFTLNVRLDNIAVITIDVPGEKMNTL KAEFASQVRAIIKQLRENKELRGVVFVSAKP DNFIAGADINMIGNCKTAQEAEALARQGQQ LMAEIHALPIQVIAAIHGACLGGGLELALAC HGRVCTDDPKTVLGLPEVQLGLLPGSGGTQ RLPRLIGVSTALEMILTGKQLRAKQALKLGL VDDVVPHSILLEAAVELAKKERPSSRPLPVR ERILAGPLGRALLFKMVGKKTEHKTQGNYP ATERILEVVETGLAQGTSSGYDAEARAFGEL AMTPQSQALRSIFFASTDVKKDPGSDAPPAP LNSVGILGGGLMGGGIAYVTACKAGIPVRIK DINPQGINHALKYSWDQLEGKVRRRHLKAS ERDKQLALISGTTDYRGFAHRDLIIEAVFENL ELKQQMVAEVEQNCAAHTIFASNTSSLPIGDI AAHATRPEQVIGLHFFSPVEKMPLVEIIPHAG TSAQTIATTVKLAKKQGKTPIVVRDKAGFYV NRILAPYINEAIRMLTQGERVEHIDAALVKFG FPVGPIQLLDEVGIDTGTKIIPVLEAAYGERFS APANVVSSILNDDRKGRKNGRGFYLYGQKG |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | | RKSKKQVDPAIYPLIGTQGQGRISAPQVAER CVMLMLNEAVRCVDEQVIRSVRDGDIGAVF GIGFPPFLGGPFRYIDSLGAGEVVAIMQRLAT QYGSRFTPCERLVEMGARGESFWKTTATDL Q |
| SEQ ID NO: 186 | ydiO | >gi\|90111318\|ref\|NP_416210.4\| putative acyl-CoA dehydrogenase [*Escherichia coli* str. K-12 substr. MG1655] | MDFSLTEEQELLLASIRELITTNFPEEYFRTCD QNGTYPREFMRALADNGISMLGVPEEFGGIP ADYVTQMLALMEVSKCGAPAFLITNGQCIH SMRRFGSAEQLRKTAESTLETGDPAYALALT EPGAGSDNNSATTYTRKNGKVYINGQKTFI TGAKEYPYMLVLARDPQPKDPKKAFTLWW VDSSKPGIKINPLHKIGWHMLSTCEVYLDNV EVEESDMVGEEGMGFLNVMYNFEMERLINA ARSTGFAECAFEDAARYANQRIAFGKPIGHN QMIQEKLALMAIKIDNMRNMVLKVAWQAD QHQSLRTSAALAKLYCARTAMEVIDDAIQIM GGLGYTDEARVSRFWRDVRCERIGGGTDEI MIYVAGRQILKDYQNK |
| SEQ ID NO: 187 | paaJ | >gi\|16129358\|ref\|NP_415915.1\| 3-oxoadipyl-CoA/3-oxo-5,6-dehydrosuberyl-CoA thiolase [*Escherichia coli* str. K-12 substr. MG1655] | MREAFICDGIRTPIGRYGGALSSVRADDLAAI PLRELLVRNPRLDAECIDDVILGCANQAGED NRNVARMATLLAGLPQSVSGTTINRLCGSGL DALGFAARAIKAGDGDLLIAGGVESMSRAPF VMGKAASAFSRQAEMFDTTIGWRFVNPLMA QQFGTDSMPETAENVAELLKISREDQDSFAL RSQQRTAKAQSSGILAEEIVPVVLKNKKGVV TEIQHDEHLRPETTLEQLRGLKAPPRANGVIT AGNASGVNDGAAALIIASEQMAAAQGLTPR ARIVAMATAGVEPRLMGLGPVPATRRVLER AGLSIHDMDVIELNEAFAAQALGVLRELGLP DDAPHVNPNGGAIALGHPLGMSGARLALAA SHELHRRNGRYALCTMCIGVGQGIAMILERV |
| SEQ ID NO: 188 | yqeF | >gi\|90111494\|ref\|NP_417321.2\| putative acyltransferase [*Escherichia coli* str. K-12 substr. MG1655] | MKDVVIVGALRTPIGCPRGALAGHSAVELGS LVVKALIERTGVPAYAVDEVILGQVLTAGA GQNPARQSAIKGGLPNSVSAITINDVCGSGL KALHLATQAIQCGEADIVIAGGQENMSRAPH VLTDSRTGAQLGNSQLVDSLVHDGLWDAFN DYHIGVTAENLAREYGISRQLQDAYALSSQQ KARAAIDAGRFKDEIVPVMTQSNGQTLVVD TDEQPRTDASAEGLARLNPSFDSLGSVTAGN ASSINDGAAAVMMMSEAKARALNLPVLARI RAFASVGVDPALMGIAPVYATRRCLERVGW QLAEVDLIEANEAFAAQALSVGKMLEWDER RVNVNGGAIALGHPIGASGCRILVSLVHEMV KRNARKGLATLCIGGGQGVALTIERDE |
| SEQ ID NO: 189 | tig | >gi\|16128421\|ref\|NP_414970.1\| peptidyl-prolyl cis/trans isomerase (trigger factor)[*Escherichia coli* str. K-12 substr. MG1655] | MQVSVETTQGLGRRVTITIAADSIETAVKSEL VNVAKKVRIDGFRKGKVPMNIVAQRYGASV RQDVLGDLMSRNFIDAIIKEKINPAGAPTYVP GEYKLGEDFTYSVEFEVYPEVELQGLEAIEV EKPIVEVTDADVDGMLDTLRKQQATWKEK DGAVEAEDRVTIDFTGSVDGEEFEGGKASDF VLAMGQGRMIPGFEDGIKGHKAGEEFTIDVT FPEEYHAENLKGKAAKFAINLKKVEERELPE LTAEFIKRFGVEDGSVEGLRAEVRKNMEREL KSAIRNRVKSQAIEGLVKANDIDVPAALIDSE IDVLRRQAAQRFGGNEKQALELPRELFEEQA KRRVVVGLLLGEVIRTNELKADEERVKGLIE EMASAYEDPKEVIEFYSKNKELMDNMRNVA LEEQAVEAVLAKAKVTEKETTFNELMNQQA |
| SEQ ID NO: 190 | atoD | >gi\|16130158\|ref\|NP_416725.1\| acetyl-CoA: acetoacetyl-CoA transferase, alpha subunit [*Escherichia coli* str. K-12 substr. MG1655] | MKTKLMTLQDATGFFRDGMTIMVGGFMGI GTPSRLVEALLESGVRDLTLIANDTAFVDTGI GPLIVNGRVRKVIASHIGTNPETGRRMISGEM DVVLVPQGTLIEQIRCGGAGLGGFLTPTGVG TVVEEGKQTLTLDGKTWLLERPLRADLALIR AHRCDTLGNLTYQLSARNFNPLIALAADITL VEPDELVETGELQPDHIVTPGAVIDHIIVSQES K |
| SEQ ID NO: 191 | atoA | >gi\|16130159\|ref\|NP_416726.1\| acetyl-CoA: acetoacetyl-CoA | MDAKQRIARRVAQELRDGDIVNLGIGLPTM VANYLPEGIHITLQSENGFLGLGPVTTAHPDL VNAGGQPCGVLPGAAMFDSAMSFALIRGGH |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | transferase, beta subunit [*Escherichia coli* str. K-12 substr. MG1655] | IDACVLGGLQVDEEANLANWVVPGKMVPG MGGAMDLVTGSRKVIIAMEHCAKDGSAKIL RRCTMPLTAQHAVHMLVTELAVFRFIDGKM WLTEIADGCDLATVRAKTEARFEVAADLNT QRGDL |
| SEQ ID NO: 192 | atoE | >gi\|16130160\|ref\|NP_416727.1\| short chain fatty acid transporter [*Escherichia coli* str. K-12 substr. MG1655] | MIGRISRFMTRFVSRWLPDPLIFAMLLTLLTF VIALWLTPQTPISMVKMWGDGFWNLLAFG MQMALIIVTGHALASSAPVKSLLRTAASAAK TPVQGVMLVTFFGSVACVINWGFGLVVGA MFAREVARRVPGSDYPLLIACAYIGFLTWGG GFSGSMPLLAATPGNPVEHIAGLIPVGDTLFS GFNIFITVALIVVMPFITRMMMPKPSDVVSID PKLLMEEADFQKQLPKDAPPSERLEESRILTL IIGALGIAYLAMYFSEHGFNITINTVNLMFMI AGLLLHKTPMAYMRAISAAARSTAGILVQFP FYAGIQLMMEHSGLGGLITEFFINVANKDTF PVMTFFSSALINFAVPSGGGHWVIQGPFVIPA AQALGADLGKSVMAIAYGEQWMNMAQPF WALPALAIAGLGVRDIMGYCITALLFSGVIF VIGLTLF |
| SEQ ID NO: 193 | atoB | >gi\|16130161\|ref\|NP_416728.1\| acetyl-CoA acetyltransferase [*Escherichia coli* str. K-12 substr. MG1655] | MKNCVIVSAVRTAIGSFNGSLASTSAIDLGAT VIKAAIERAKIDSQHVDEVIMGNVLQAGLGQ NPARQALLKSGLAETVCGFTVNKVCGSGLK SVALAAQAIQAGQAQSIVAGGMENMSLAPY LLDAKARSGYRLGDGQVYDVILRDGLMCAT HGYHMGITAENVAKEYGITREMQDELALHS QRKAAAAIESGAFTAEIVPVNVVTRKKTFVF SQDEFPKANSTAEALGALRPAPDKAGTVTA GNASGINDGAAALVIMEESAALAAGLTPLAR IKSYASGGVPPALMGMGPVPATQKALQLAG LQLADIDLIEANEAFAAQFLAVGKNLGFDSE KVNVNGGAIALGHPIGASGARILVTLLHAMQ ARDKTLGLATLCIGGGQGIAMVIERLN |
| Fatty acid pathway 3-keto-acyl-CoA synthases | | | |
| SEQ ID NO: 1 | NphT7 | >gi\|299758082\|dbj\|BAJ10048.1\| acetyl-CoA: malonyl-CoA acyltransferase [*Streptomyces* sp. CL190] | MTDVRPRIIGTGAYVPERIVSNDEVGAPAGV DDDWITRKTGIRQRRWAADDQATSDLATAA GRAALKAAGITPEQLTVIAVATSTPDRPQPPT AAYVQHHLGATGTAAFDVNAVCSGTVFALS SVAGTLVYRGGYALVIGADLYSRILNPADRK TVVLFGDGAGAMVLGPTSTGTGPIVRRVAL HTFGGLTDLIRVPAGGSRQPLDTDGLDAGLQ YFAMDGREVRRFVTEHLPQLIKGFLHEAGV DAADISHFVPHQANGVMLDEVFGELHLPRA TMHRTVETYGNTGAASIPITMDAAVRAGSFR PGELVLLAGFGGGMAASFALIEW |
| SEQ ID NO: 194 | SaFabH | >gi\|75765832\|pdb\|1ZOW\|A Chain A, Crystal Structure Of *S. Aureus* Fabh, Beta-Ketoacyl Carrier Protein Synthase Iii | MNVGIKGFGAYAPEKIIDNAYPEQFLDTSDE WISKMTGIKERHWADDDQDTSDLAYEASVK AIADAGIQPEDIDMIIVATATGDMPFPTVAN MLQERLGTGKVASMDQLAACSGFMYSMIT AKQYVQSGDYHNILVVGADKLSKITDLTDR STAVLFGDGAGAVIIGEVSEGRGIISYEMGSD GTGGKHLYLDKDTGKLKMNGREVFKFAVRI MGDASTRVVEKANLTSDDIDLFIPHQANIRI MESARERLGISKDKMSVSVNKYGNTSAASIP LSIDQELKNGKLKDDDTIVLVGFGGGLTWG AMTIKWGK |
| SEQ ID NO: 195 | BsFabH | >gi\|321314863\|ref\|YP_004207150.1\| 3-oxoacyl-(acyl carrier protein) synthase III [*Bacillus subtilis* BSn5] | MKAGILGVGRYIPEKVLTNHDLEKMVETSD EWIRTRTGIEERRIAADDVFSSHMAVAAAKN ALEQAEVAAEDLDMILVATVTPDQSFPTVSC MIQEQLGAKKACAMDISAACAGFMYGVVT GKQFIESGTYKHVLVVGVEKLSSSITDWEDRN TAVLFGDGAGAAVGPVSDDRGILSFELGA DGTGGQHLYLNEKRHTIMNGREVFKFAVRQ MGESCVNVIEKAGLSKEDVDFLIPHQANIRI MEAARERLELPVEKMSKTVHKYGNTSAASI PISLVEELEAGKIKDGVVVMVGFGGGLTW GAIAIRWGR |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| SEQ ID NO: 196 | PaFabH | >gi\|15598482\|ref\|NP_251976.1\| 3-oxoacyl-ACP synthase [*Pseudomonas aeruginosa* PA01] | MESFNTFVRQYNDQHAEAIAKGELEALAESS SAFIEKASGIKSRFVMNKEGILDPQRMVPYLP ERSNDEWSILCEMAVAAAREALQRAGRSAA DIDGVIVACSNLQRAYPAIAVEVQAALGIQG YGYDMNVACSSATFGIQAATTAIQTGQARAI LMVNPEICTGHLNFRDRDSHFIFGDACTAVI VERADLAVSKHQFDIVSTRLLTQFSNNIRNN FGFLNRADESGIGKRDKLFVQEGRKVFKDV CPMVAELIGEHLAANEIQVAEVKRFWLHQA NLNMNLLITRKLLGRDAEAHEAPVILDSYAN TSSAGSVIALHKHQDDLPSGAIGVLSSFGAG YSIGSVILRKH |
| SEQ ID NO: 197 | MtFabH | >gi\|2113995\|emb\|CAB08984.1\| 3-OXOACYL-[ACYL-CARRIER-PROTEIN] SYNTHASE III FABH (BETA-KETOACYL-ACP SYNTHASE III) (KASIII) [*Mycobacterium tuberculosis* H37Rv] | MTEIATTSGARSVGLLSVGAYRPERVVTNDE ICQHIDSSDEWIYTRTGIKTRRFAADDESAAS MATEACRRALSNAGLSAADIDGVIVTTNTHF LQTPPAAPMVAASLGAKGILGFDLSAGCAGF GYALGAAADMIRGGGAATMLVVGTEKLSPT IDMYDRGNCFIFADGAAAVVVGETPFQGIGP TVAGSDGEQADAIRQDIDWITFAQNPSGPRP FVRLEGPAVFRWAAFKMGDVGRRAMDAAG VRPDQIDVFVPHQANSRINELLVKNLQLRPD AVVANDIEHTGNTSAASIPLAMAELLTTGAA KPGDLALLIGYGAGLSYAAQVVRMPKG |
| SEQ ID NO: 198 | FabH | >gi\|345301988\|ref\|YP_004823890.1\| 3-oxoacyl-ACP synthase III [*Rhodothermus marinus* SG0.5JP17-172] | MLPEQSLTTPLPATTTAAPARRAAVLGVGA ALPAHREPSAETERRLGLPPGWIARRTGIRER PLVGPDEATSDLAVRAGAAALAQAELSPERI GLLLLATSTPDHLLPPTAPVVAHRLGLKHAG AIDLAGACSGFLYALALADGYVRLQRTCVL VIGANVLSRRTNPDDPKTSALFADGAGAVV LGPSEGSRGIVACWLGADGSCWDDLYIPAG GSRRPLTPERVARGEHLMYMKDGRALFRRA ATGMAEAGRRVLQQAGLDLDDVAWWIPHQ ANLRLIEEARRQLGMPEARTVNLVDRIGNSS AATIPLALALEAHRFAPGDLLLLTAVGAGLL SAAVLIQW |
| SEQ ID NO: 199 | FabH | >gi\|471324089\|ref\|YP_007523119.1\| 3-oxoacyl-[acyl-carrier-protein]synthase 3 protein 3 [*Streptomyces davawensis* JCM 4913] | MTAPTAVLAGLGSALPPRVVTNHDLTARMD TSDEWIRTRTGIAERRIVDPGGATSDLAIEAG RRALDSAGGPDVGAVVVATATPDHPCPATG PTVAAGLGLGTVPAFDVGAVCSGFLYALAT GAGLIAASVADSVLVVGADAFTTIVDPYDRN TAPIFADGAGAVVLRAGRADEPGALRRTEL ASDGMQADLIRVAAGGSRQRSHHSAALRED QYLTMRGGEVFKNAVLRMTEASRTVLDRTG WSTAEVDLLVGHQANVRILHAVAEQLGIGQ ERAYVNIGHTGNTAAASIPLALDDAHGEGRL RAGDKVLLTAFGAGTTWGAITLTWPEGLQY RGAAGSAAA |
| SEQ ID NO: 200 | FabH | >gi\|330444499\|ref\|YP_004377485.1\| 3-oxoacyl-ACP synthase III [*Chlamydophila pecorum* E58] | MDKIKKAAILATGSYLPEKILSNADLEKMVD TSDEWIVTRTGIKERRIASDNEYTSDMGAKA AEKAIRASGLSKDLIDCIVFATSAPDYIFPSSG ALAQAYLGIKEVPAFDCLAACTGFLYGLSIA KAYVESGTYNHVLLIAADKLSSFVNYQDRN TCVLFGDGGAACIVGRSRPGALEINQVCLGA DGALGDLLSLPAGGSRNPATEATLKEGRHYI SMEGKEVFKHAVRRMEAASKASIAVAGIQE EQVGWLVPHQANERIIDAIAKRFNISEAKVF KSLYKYGNTAASSLGIALDELLNTETVLPHE YLLLTAFGGGLSWGSVVLEHV |
| SEQ ID NO: 201 | FabH | >gi\|459068159\|ref\|ZP_23165498.1\| 3-oxoacyl-(acyl-carrier-protein) synthase III [*Clostridium ultunense* Esp] | MNSLYSVGITGIGSYVPEKVITNYDLCEIVDT SNEWIVERTGIQERRIVDQSLSTSDIGTIAAN KALEDSNTNPKEIDLIIVATATPDMAFPSTAC IVQKNIQAINAAAFDISAGCSGFIYGLSIGFNF IKAGTYRKVLVIGGETLSKIVNWEDRNTCVL FGDGAGACILERCEEGFGFLTFDLSGDGNNG HLLIQPAGGSRLPASYETVSNRLHTIKMDGR EVFKFAVRIIEKSSKEVLRKANIPLEQIDLLIP HQANMRIIQSAIKKLQLEENKVYINLDKYGN MSSASIPVALDEAYKKEFFSKGDIVLLVAFG AGLTWGATLLRWNK |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
| --- | --- | --- | --- |
| SEQ ID NO: 202 | FabH | >gi\|383454618\|ref\|YP_005368607.1\| 3-oxoacyl-(acyl-carrier-protein) synthase III [*Corallococcus coralloides* DSM 2259] | MARTHIIGTGSYAPTQVLTNQDLERLVETSD AWIRERTGIQERRQAAPDEATSDLAVNAAR NALEMAGVAPGDLDLIVVGTVTADMPMPSC AALVQSKLGAKRAFAFDVSAACAGGLYALS VADQFVRSGQVKRALVVGADLLTRAVDWT DRNTCVLFGDGAGALVLGAEQDADEDAMA PRGILSTHLRTDGDLANLLCIPAGGSRTPVTA DNVDANLHKLKMNGKEVFRFAVRALVEST QASLGAHGMDTTQVDHVIAHQANLRILEAV MERLEIPKEKCWLNLHKYGNTSSASLPMSLD EAQRAGRLKRGDVIAMMAIGAGMAWGSAV VRW |
| SEQ ID NO: 203 | FabH | >gi\|333371191\|ref\|ZP_08463153.1\|3-oxoacyl-[acyl-carrier-protein]synthase III [*Desmospora* sp. 8437] | MRIMGSVGIIGTGAYLPEKVLTNADLEKMV DTNDEWIVSRTGIRERRIAADDQASSDLAVE AGRRALESAGIEAKDLDLIIVATVTPDMAFP ATACLVQDRLGAEKAATFDLSAACTGFLYGI SVASQFISNGMYRHALVIGVDCLSKITDFTD RNTCVLFGDGAGAAVLGPVEEGKGFLSFEL GGDGSGGHLLKQPAGGSRIPASGKSVEDRLH FISMNGREVFKFAVRVLGSSAEEALRKAGM TKEDVDFLIPHQANTRIIDTAVQRLGLSRDK VVVNLDRYGNMSSASIPVALDEAVQRGKIK KDDTLVLVGFGGGMTWGASVMKWTMETK |
| SEQ ID NO: 204 | FabH | >gi\|390454110\|ref\|ZP_10239638.1\| 3-oxoacyl-(acyl-carrier-protein) synthase III [*Paenibacillus peoriae* KCTC 3763] | MNKLRPVGIIGTGKYVPEKILTNKDLEAIVET SDEWIVSRTGIQERHIAAPEQATSDLAYEAAI KALKSAGMTAEDLDLIIVATVTPDMAFPSTA CILQDKLGAKGAAAFDLSAACSGFVYGLAT ATSFIKTGIYNNALIIGADCLSRITDYTDRNTC VLFGDGAGAVVIGEVSEGRGFQSFDLGAEG AGGSLLNLAAGGSRLPASADTLENKQHYIY MNGREVFKFAVRVMGTATVDVLEKAGLTK DDIDLFVPHQANIRIIQSAMQRLDLPEEKVVI NVNKYANTSAASIPLALVEAAEEGRMKEGD RVLMVGFGGGLTWGASVLVW |
| SEQ ID NO: 205 | FabH | >gi\|392959403\|ref\|ZP_10324886.1\| 3-oxoacyl-(acyl-carrier-protein) synthase 3 [*Pelosinus fermentans* DSM 17108] | MNKKCVGIIGLGSYVPQRIMTNKDLEERMD TSDQWIVERTGIHERRVAAENESTSDLAAKA GQKALEDAKISPAEIDLIIVATASPDMVFPAT ACVVQENIKAVNAAAFDISAVCSGFLYAMIT GSQFIKAGTYRKVLVIGAETLSRFTDWSDRN TGMLFGDGAGAAVLGETPEGYGILGVDLGA DGGGAELLKIPAGGSRHPATMETILQKQHFI YMNGNEVFKFAVKVMGETTLKALKNANLT ASDITYLVPHQANIRIIQSAAKRLGIPMEKVV VNINKYGNTSAASIPIALDEAVKSGAIKSGDI VALAGFGGGLTWASSIMKWCK |
| SEQ ID NO: 206 | FabH | >gi\|116626090\|ref\|YP_828246.1\| 3-oxoacyl-ACP synthase [*Candidatus Solibacter usitatus* Ellin6076] | MPKAKISALGCYTPPRVLTNQDLEKLVDTN DQWIMERTGIRERHIAAPEMATSDMAIEAAR CALLQRGIDACEIDAIILCTVTPDHLFPSTACL VQNAIGAKGAWGFDLIAACSGFLYGLTTGA HFVMAGTHKKVLVIGSDTMSRIIDYTDRATC VLFGDGAGAMLIEATDEADDGTGFIDFLGEI DGSGGEFLRMPAGGSRRPASHETVDQRMHY VHQEGSQVFKYASRKMYEVCRDLLERNHFK VEDVGLMIPHQANKRIIKAAGDRLGIAPERV MINIERYGNTTAGTLPLATRDAISEGRLKKG DLVLFAAVGAGYTVGASLWRWAF |
| SEQ ID NO: 207 | FabH | >gi\|323702691\|ref\|ZP_08114352.1\| 3-oxoacyl-(acyl-carrier-protein) synthase III [*Desulfotomaculum nigrificans* DSM 574] | MSSNLVQAGIIGVGSYVPERILTNKDLEKMV DTSDEWITSRTGIKERRIADPEESTSELAVKA ARRALAHAGVKPEELDLIILATCTKDMPFPA SACLVQDQLGAVNAGAFDIEAGCTGFVYAL TVGSQFVATGSMKRVLVIGADNLSKVTNWE DRNTCVLFGDGAGAVVLGPVAPGEGILASK LAAEGAGWKYLSMPAGGSRMPASPLTVEK KLHYIHMQGREVFRYAVKVMEEEAANIVKA AGLALSDIDLLIPHQANIRIIEHAAKKLKLSM DKVVVNVDRYGNTSTASIPLALDEAVKSGR VKAGDNIVMVAFGAGLTSGAIVLKWSLGEG KE |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| SEQ ID NO: 208 | FabH | >gi\|384566084\|ref\|ZP_10013188.1\| 3-oxoacyl-(acyl-carrier-protein) synthase III [Saccharomonospora glauca K62] | MSTGILGAAGYLPPRVIDNDQVGAWVDRDP DWILERTGIKERHYAAPEVSTSDMACLAVEK LYASCPEKRASVGAVILGTSTPDHNFPSTAAI VQGRMGLGRAFADLSAACSGYLFSFVTAH SLLSANPALEEVLVIGADTISKVLYQSDRKTV TVFGDGAAATRVGRVPDGYGLLTHTLITDG CHADYVGQPAGGSRRPLDATTVNARERYM VMHGRKVREYFEEVVPKLIHEVVEQAGVSL DDIDHFVFHQANPQMLADCINAMGIDPAKC PVPGVLSGNTGAASIPLVLSELRAERGDLVV MAAIGSGMTAGAAVLRWY |
| SEQ ID NO: 209 | FabH | >gi\|298162138\|gb\|ADI 59524.1\| CorB [Corallococcus coralloides] | MNQGGVFPLPFKIAGLGRYVPADVVLSSDLE KKYDLPPGWCVEKQGIRERRWVKDETASFM GAEEAAKEAVRDAGLKLEDIDLIINASGSPEQ AVPDGGPLVQRELGLGRSGVPSITVNASCLS FFVALDVAANYLNMRRYKRILIVSSDISSVA LDFRKPENFTLFGDAAAAAVVTLPEPGEKSC IHASQVRTYGYGAEFSMVPGGGSRRHPNGK NTTPEDNYLHMNGAELLKIGFEYLPRFNEAL WKQCPDITIKDCRYVIPHQPSRVVLDYLSLT YPDDKLVRIIDRFANCIGASMPMALYEAVKV GGLRRGERGVLTGTGSGVSFVGMVFTY |
| SEQ ID NO: 210 | FabH | >gi\|148359775\|ref\|YP_001250982.1\| 3-oxoacyl-(acyl carrier protein) synthase III FabH [Legionella pneumophila str. Corby] | MNFFRCEKPIYIKGPFVALPERVMSNQDVLN WMNSTQNPAVIGFSTGIKNRHWVNEDQACS DLAVRAAEHLFMEKPREKHKVNQVILATISG DYPSPPSSPLVQYRLGLQNAGAFDIGAACAG FVVGLHTSAALAQTNDGSVLLIASEIRSKFLN KNNFATSVLFGDGAAACCVSQDKEEADFRFI ASALFADGEVYDAVSTPAGGSRLPAAVCND NEQFYITIKESTALFVKAVHGMADSAKDFLK ELNLTISDIQWLVPHQGNKNLVLSVAKQLGF PEEKTIKTVEETGNTSGSSVGIALDRLRSDGK IKSGEKVLLVAAGGGGIAACSLLEVI |
| SEQ ID NO: 211 | FabH | >gi\|15824218\|dbj\|BAB69376.1\| 3-oxoacyl-(acyl carrier protein) synthase [Streptomyces avermitilis] | MTNEHLARRLDTDDAWIRTRTGIRRRHAVD PGQATSDLAVEAGRRALVCAATASVDAVVV ATTTPDHSCPATAPAVAARLGLTGAAAFDIS AVCTGFVYGLASAAGLIAAGVAERVLLIGA DTYSTIVDPLDRANAIIFGDGAGAVVLRAGH PDEPGAVGHFDLGSDGAHEDLIMVAAGGSR QRSRPGEPSRQDRHFGMRGKEVYRHAVTRM AESARATLSRAGWKTDDVDHFVPHQANLRI LHSVADDLGLPRERCVTHVESVGNTGAASIP LALADAAAGQTLRPGDRVLLTAFGGGLTWG SCLLTWPTLPAPAPPYDPHAQGERTTS |
| SEQ ID NO: 212 | FabH | >gi\|330468931\|ref\|YP_004406674.1\| 3-oxoacyl-(acyl carrier protein) synthase III [Verrucosispora mans AB-18-032] | MALSSHVEYESTTRTAVIAGLGAYVPDQVV KNEEIAARLGVTTDWIRDRTGIEQRFVLNPE GATSDLAVEAARRALDSCGNPDIDFLILATC TPDHLFPSTAPSVASRLGFKGIAAFDLNAACS GFVYALSVSTGMLATGAYRTGLVIGADAISS ILNHDDEITGPIFGDGGGAVVVRAGHLGETG SVSVQQLGSDGDLLDIMKTPGGGSRQAAG VPVDIDSSYFTMSGRAVYKHAINRMSTVSRS VLERLGWTPDDVDWLIAHQANRRILTATAE EIGIAPERAVINVDRVANTSAASIPLAMVDA VESGALTAGDKVLLAAFGGGATWAAAGLT WPELTLAPTQTVR |
| SEQ ID NO: 213 | FabH | >gi\|32444698\|emb\|CAD74700.1\| 3-oxoacyl-(acyl-carrier protein) synthase [Rhodopirellula baltica SH 1] | MIETSSNVTANDLAAKSVNEESSAESTAVPT EAVSAVMPGNATTRGRMGNLKGVRIAGTGS YVPERIVTNEDLAALGCDSDWIVRRTGILQR RHAEPGQATSDLCYEAALRCLENANVSVDEI DLILVATITPDHPTPSTACHLQRRLGAVAPA MDIGAACAGFMYALVTGAQFVSNGNARNV LVIGADLMSRTVDPEDKKTYPLFGDAAGAA LLVPSTQDECQSTECNGSAADSTIQTDGLLA YQLGSEGCGGEMLCIPAGGSRTPITTDGEDS ASRYLQMDGRGVFKWAVRVFDESAKDVLR AANVSSDQLSLVVLHQANQRIIDSAVSDLNV PPEKVFVNLDKYGNTSGASIPLALDEAARAG RLKEGDLVLLCGFGAGLAWGTALFRW |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| SEQ ID NO: 214 | FabH | >gi\|392374495\|ref\|YP_003206328.1\| 3-oxoacyl-[acyl-carrier-protein]synthase III (Beta-ketoacyl-ACP synthase III)(KASIII) [Candidatus Methylomirabilis oxyfera] | MYGSRIAGTGASVPDRVLTNAELEQMVSTS DEWIVTRTGISERRIASDDQATSDLAEGAAR QALEASGVDPHDLDLILVNTVTPDMFFPSTA CVLQERLGASRAAAFDLMAACAGFVYGLSV ADAYLRAGVMRNILVIGADTLSKVVDWSDR GTCVLFGDGAGAVVVQRTTADPAILSTHLYS DGSKGRQLIIPGGGSRQPASQKVIDEKLVTIR MPNGNEVFKTAVRSMEEAAIAALKANGAEV SDVDLFISHQANARIIYAVAERLDLPRERIYM NIDRYGNTSAASIPIAMDEAVRAGRLKRGDL LLLTAFGGGFTWGSALIRW |
| SEQ ID NO: 215 | FabH | >gi\|317121784\|ref\|YP_004101787.1\| 3-oxoacyl-(acyl-carrier-protein) synthase III [Thermaerobacter marianensis DSM 12885] | MVAAVRGVTIAGIGGCVPPAVVTNDDLAQV VETDDEWIRTRTGIRQRRVADPGTATSDLAE VAARRALEEAGVRPDQVDLIIVATVTPDMPF PSTACLLQDRLGATRAAGFDLEAACSGFVY ALAAGAQFIAAGLYDTVLVVGAETLSKIIDW SDRRTCVLLGDGAGAAVLRPAAPGEGILGL YLGADGSGGDLLKQPAGGSRLPASPETVAR GLHFVQMNGREVFKFAVKTMGDAAQAALA QAGLTFDDVDLYVPHQANFRIIESSARRFDLP LERVVVNIDRYGNTSAASIPVALDEALSTGRI RAGQTVLLVAFGGGLTWGAAVVRWGYDRP APRPLEMPGQEPRYGLPEWIREQAARGRAR AGEPAQGEPAAAASEATAPAALAVPRAALD PAAVTAASPGSEGRPAWGGGGTR |
| SEQ ID NO: 216 | FabH | >gi\|383787841\|ref\|YP_005472409.1\| 3-oxoacyl-ACP synthase [Caldisericum exile AZM16c01] | MKVGVLGLGSYIPEKVVTNHDLEKFLDTSD EWIRTRTGIVERRIANENEATSDLASIAAKRA LEDANLKPEDIDLIIVGTNSPDMLYPATACLV QEKIGASGKCAAFDLQAGCPGFIYATVVGSQ FVKSGAYKHVLVIGAEVITRMMDPTDRGTY VLFGDGAGAVVLGEVEDNRGIVDFELYADG SIAEHLTLPAGGSRKPFSEEVLKERSYFTKMN GGEVFKFSVREISRISKKLLDKTGTKLEDIDW FIPHQANLRIIQAGAEKLGIPMEKVVVTIDKF GNSSAASIPVSLDTIRKEGKLKRGDLVLMVS FGAGMTSGAILMRW |
| SEQ ID NO: 217 | FabH | >gi\|404450648\|ref\|ZP_11015628.1\| 3-oxoacyl-(acyl carrier protein) synthase III [Indibacter alkaliphilus LW1] | MKKTRAVITGVQGWVPEYVLTNRELETMV DTNDEWITTRTGIKERRILKGENQGTSVIGIN AVKGLLEKTNTKAEDIDLIICATVTPDMPFPA TANIIADGVGAKNSYSYDISAACSGFLYALTI GSQFIETGMHKKVIIVGADKMSSIIDYQDRAT CIIFGDGGGAVLLEPTQEKVGIMDSLLHADG SGAPFLHMKAGGSRKPASLETIAAREHFAFQ EGSTVFKFAVTNMAEVSARIMERNNLASEDI AWLVPHQANKRIIDATANRMGVGPDKVML NIEKYGNTTAGTLPLCLWDYESQLKKGDNII LAAFGGGFTWGSIYLKWGYDPK |
| SEQ ID NO: 218 | FabH | >gi\|189502112\|ref\|YP_001957829.1\| 3-oxoacyl-(acyl carrier protein) synthase III [Candidatus Amoebophilus asiaticus 5a2] | MRTAIRASITGVHGYVPEYILTNEKLEKMVD TNDEWITTRTGIKERRILEGTNQGTSVLGIPA VRGLLEKTNTDPREIDLLICATITPDMITPATA NIIAHAVGATNAFSYDLQAACSGFLYALITG VQFIETGKYKKVVVVGADKMSSIVNYEDRN SCILFGDGAGAVLLEPNSQGYGIIDSILKGDG NGEQYLHQKAGGSRRPPSAETIAAKEHYVY QEGRAVYRFAVEKMAEVVLEIMKKNNLHH EDIKFLVPHQANKRILDAVAQRAGIKEEQVM ITIQEFGNTTGATIPLCLWRYESQLQPGDKLII TTFGGGFTWGAAYLTWAYK |
| SEQ ID NO: 219 | FabH | >gi\|395801183\|ref\|ZP_10480443.1\| 3-oxoacyl-ACP synthase [Flavobacterium sp. F52] | MSAVITAIGGYVPSSILTNKKISETVDTSEEWI IKRTGIRERRIADDDTATSDLAAAAIENLIEN YNVDREEIEALLVATATPDHILAPTASIVCDK SGLTNAFGIDMNAACSGFLYALEMGANMIE SGRYKKLIIVGADKMSSIVDYEDRNTCILFGD GAGAILLEKSESDAGLMKTILKTDGSGVSSL AVPAGGSRNPTSMQSLLHRTHYLKQDGAFV FKRAVAAMSQVSQDALAKNELEADQIDWV VPHQANLRIITAVGESLGIDFEKVKVNIDRYG NTTSATVPLCLWDFKDDFKEGQNVLITTFGA GFSWGATCLKWGVMRERKSAETITATTKAE AVLVEH |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| SEQ ID NO: 220 | FabH | >gi\|86159172\|ref\|YP_465957.1\| 3-oxoacyl-ACP synthase [*Anaeromyxobacter dehalogenans* 2CP-C] | MRSLIAGTGSYAPEKVVTNADLEKLVDTND QWIVERTGIRERHVVADDQATSDLALEASRR ALDAAGLDAKDVEMIVVGTVTPDYPFPSVG AVLQGKLGNKKAFAFDVSAACAGSLYALSV ADRFVASGAVKNALVVGADALTRITDWTDR NTCILFGDGAGAMVLKPTDDPQRGIRAVRL HADGSLVPILLQPGGGSRDPISEKVVREKSH YVKMNGREVFKVAVRSLEESCREVLADEKL TPGDVTWVIAHQANKRILDATLHRLEIPESK CWMNLEKYGNTSAASVPMTLDEANRAGWL KPGDTVLMMAIGGGMAWGASVVRW |
| SEQ ID NO: 221 | FabH | >gi\|166364688\|ref\|YP_001656961.1\| 3-oxoacyl-ACP synthase [*Microcystis aeruginosa* NIES-843] | MNGFGAAVVITGCGSATPAQFLSNEELSQIV ETSDEWIKSRTGIGKRHLADRSVSLSQLAAQ AAIKALEMAQVSPRDIDLILLATSTPDDLFGS AAQVQSQIGANRAIAFDLTAACSGFLVGLVT ATQFIRTGTYRNVLVIGADVLSRWVDWNDR ATCVLFGDGAGAVVCQANDTKDNILGFE,LH SDGSQNGSLNLAYEGEELPLKQGIRVQKGTY KPLRMNGREVYRFAVAKVPEVIEKALYRAN LTTSDIDWLVLHQANQRIMDAVSERLKLPPE KVISNLSEYGNTSAASIPLALDEAVRSGKVK KGDIIASSGFGAGLTWGGIIFRWGD |
| SEQ ID NO: 222 | FabH | >gi\|219849850\|ref\|YP_002464283.1\| 3-oxoacyl-(acyl-carrier-protein) synthase III [*Chloroflexus aggregans* DSM 9485] | MYDRKVARVSRERYAAVIGWGMAVPNRVV TNDDLAQRIDTSDEWIRTRTGIRERRVAGPG ESTSTFATAAGREALEMAGVSPATIDTVIVA TCTPDRPFPATACTVQANLQIPRATAFDLAA ACSGFVYGLTVATSLIKSGVSRRLLLIGADIF THYINWNDRNTCVLFGDGAGAVVLEATDEP LGLIASNLSADGNLEDLMAVDAGGTRMPLT AELLAEGRQYVYMNGREIFKHAVREMSESA LHVVQAAGLTIDDIALVIPHQANVRIIDAVAR RLELPPERVMINLDRYGNTSAASIPIALYEAA QQERIKAGDYVLMTAFGGGLTWGSGIVRW GRPSR |
| SEQ ID NO: 223 | FabH | >gi\|227523050\|ref\|ZP_03953099.1\| 3-oxoacyl-(acyl carrier protein) synthase III [*Lactobacillus hilgardii* ATCC 8290] | MKFENFKILATASQVPTRVVDNDELSTMMD TSDDWIVQRTGIRRRHIAVDETTSSLCTSYAK QLLEKTGLKPSEIDLIIVATMSPDYLTPSVSA MVQGNLGADHAVAMDIDAACSGFVYGLNM VKQLLIAETPKNAILIGGEMLSKLIDWQDRST AVLFGDGAGGVLLKNTPKAEGAFISENLKTL GKLGRYLTAGKTGAPTPFMEKKDEFSPFFQ MNGRRVYRFAVNNVPESINQALAEASLTTD DIDHFVLHQANSRIVEKIAETLGVSMDKFPIN IDEYGNTAAASEPILLDQLVTNGTIKRGDVV LLSGFGGGLTVGTMILKY |
| SEQ ID NO: 224 | FabH | >gi\|240850683\|ref\|YP_002972083.1\| 3-oxoacyl-(acyl carrier protein) synthase III [*Bartonella grahamii* as4aup] | MIRSIIRGVGSALPKRSLSNDEIAKFVETSDS WIVQRTGIRQRYIASENETTVSLGVEAAQAA LTNAGLTIKDIDCIILATSTPNRTFPASAVEIQ CALGMSHGFAFDIQAVCSGFIFALTTGDSYL RCGAAKRILVIGSDTFSRILDWEDRTTCVLFG DGAGAAILEAQEIEGGIAFERGILSAKLRSNG AYIDKLYVDGGPSTTQTTGYLRMEGREVFK YAVGMITDVVDDCFAAAGMDSSQLDWFVP HQANKRIIEASAKKLGISLDKVVITVDQHGN TSAASVPLALTTAVCDGKIKEGDLIMLEAMG GGFTWGAILIRW |
| SEQ ID NO: 225 | FabH | >gi\|253681256\|ref\|ZP_04862054.1\| 3-oxoacyl-[acyl-carrier-protein]synthase 3 [*Clostridium botulinum* Dstr. 1873] | MYNVKIISTGKYIPDNVVTNDDMSKFVDTN DKWISERTGIKERRISTGENTSHMAVKAALA ALEKSSVKATDLDLIIIATCTPDSFVPSTACIV QDKLGATKATCFDISAACTGFIYALGVASQFI KTGQVKNALVIGAETLSKILNWEDRSTCILF ADGAGAAIIERSEEVGLISQYTGSDGTGGKA LKCEALPVRNPYCKVDDKFKDTLSMEGREV FKFAVNAMIESINKVLENTEYTLDDIDYIVPH QANIRIIEFVSKKLGISQDKFYVNLHKYGNTS GASIPIALDEMNKKGMFKKGDNIILVGFGGG LTFGAHLIQWN |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| SEQ ID NO: 226 | FabH | >gi\|254286853\|ref\|ZP_04961806.1\| 3-oxoacyl-(acyl-carrier-protein) synthase III [*Vibrio cholerae* AM-19226] | MYSKILGTGSYLPSQVRTNADLEKMVETSDE WIVARTGIRERRIAADNETVADMAFFAAQN AIDMAGIDKHDIDMIIVATTSASHTFPSAACQ VQGKLGIKGCPAFDLAAACSGFMYALSIAD QHVKSGMCKHVLVIGADALSKTCDPTDRSTI ILFGDGAGAVVVGASNEPGILSTHIHADGEF GDLLSLEVPVRGGDSDKWLHMAGNEVFKV AVTQLSKLVVDTLKANNMHKSELDWLVPH QANYRIISATAKKLSMSLDQVVITLDRHGNT SAATVPTALDEAVRDGRIQRGQMLLLEAFG GGFTWGSA |
| SEQ ID NO: 227 | FabH | >gi\|282854072\|ref\|ZP_06263409.1\| 3-oxoacyl-[acyl-carrier-protein]synthase 3 [*Propionibacterium acnes* J139] | MTAIKTRPVHGYSKFLSTGSARGSRVVTNEE MCTLIDSTPEWIEQRTGITERRWATSSETVAS MGTTAARTALERSGLEASQIDAIIVATSVHH RPSPSLAAYIARELGLGDAAAFDLNGACAGF CYSTALADSMIRTGSANYVLVIGVEKLSEMT NLDDDRSTAFLFSDGAGAAIISASDEPGIGPVV WGSRSDQLKTIELEDWPTASADPNKIHPLIR MEGRAVFKWAMTDVAKRAAEAVAEAGITP ADLDVFIPHQANDRITDVVSRHLKLPESVTV CHDIADMGNTSAASVPIAIDRMLQRGQAHS GDLALIIGFGAGLVYAGQVIRLP |
| SEQ ID NO: 228 | FabH | >gi\|291439887\|ref\|ZP_06579277.1\| 3-oxoacyl-(acyl carrier protein) synthase III [*Streptomyces ghanaensis* ATCC 14672] | MAKIKPSKGAPYARILGVGGYRPTRVVPNEV ILETIDSSDEWIRSRSGIETRHWASPEETVAA MSVEASGKAIADAGIDAAQIGAVVVSTVSHF AQTPAIATEIADRLGTDRAAAFDISAGCAGF GYGLTLAKGMVVEGSAEYVLVIGVERLSDL TDLEDRATAFLFGDGAGAVVVGPSQEPAIGP TVWGSEGDKSETIKQTVPWTDYRDGTVEKF PAITQEGQAVFRWAVFEMAKVAQQALDAA GITADDLDVFIPHQANVRIIDSMVKTLKLPEH VTVARDIRTTGNTSAASIPLAMERLLATGEA KSGDTALVIGFGAGLVYAASVVTLP |
| SEQ ID NO: 229 | FabH | >gi\|294791665\|ref\|ZP_06756813.1\| 3-oxoacyl-(acyl-carrier-protein) synthase III [*Veillonella* sp. 6_1_27] | MTMMNKPVGIIGTGSFLPDNVVTNFDLEKM VDTNDQWIRERTGIEERRIAPEGMNTSYMAT EAAKKAMQMANVTAEEIDMIIFATLTPDMII PSAACVLQANLGAKNAAAYDLQAACSGFV YGLITAASYISSGIYKKVLVVGAEILSRRVNW NDRGTCILFGDGAGAAVVSEVPEGYGIKGID MGADGTGGSALCIPAGGTAVVANDQRVEEG LTFIHMDGPEVYKFAVKTMGRTVLKSLERA SMELNELDYFIPHQANIRIIDSAAKRLHLPME KVFVNLHKYGNTSAASVAIALDEANREGRF KRGDNVAFAGFGAGLTWASLVLKWY |
| SEQ ID NO: 230 | FabH | >gi\|302539498\|ref\|ZP_07291840.1\| 3-oxoacyl-[acyl-carrier-protein]synthase III [*Streptomyces* sp. C] | MTAIGILGTGSYLPADTVSNRVVGERAGVTE DWILQKTGIRERRYAAEYEATSDLAVEAARS ALDAAGISAEQLSWIVVATSTPDSPQPATAC LVQHRIGAVNAAAFDVNSVCSGFVFGLVAA ARMLPGQDGGVRGHALVIGADVYSRIIDRE DRRTAVLFGDGAGAVVLGPVRSGYGVLGSY LASRGDQAELIRVEAGGSRLPASEKTVAEGL HHFRMNGRGVRDFVAAELPRAVGEVLDRH GLERSEVDHFVPHQANGVMLGETVPRLGLP RARTHLTVAEHGNTSAASIPLALDEAYRSGA PRDRDVVLLAGFGGGMSLGTVLVRWDEEA APAPRKDSAA |
| SEQ ID NO: 231 | FabH | >gi\|318080591\|ref\|ZP_07987923.1\| 3-oxoacyl-(acyl-carrier-protein) synthase III [*Streptomyces* sp. 5A3_actF] | MDNSELCATVASTPEWIETRSGIRARGFAAP DETLRFMGRAAAEKALARAGVLPDGIDLVL VASMSRLEQTPPLAVLLAEDLGARAAAGLD VSGACAGFCHALALASDAVRAGSARHVLVV GTERMTDLVERADRTVSVLFADGAGAAVV GPSARPGISPPARGAAGRYAGALRMDRGWD AFAADPSLGRPWMRMDGRRVFRWAMDEVT PRAAELLRESGIEPEALDAFVPHQANLRMIEL MAERLGLPERTAVARDVVRAGNTSAASVPL ALEALLDSGEVGSGDRALLVGFGAGLNYAA QVVELP |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| SEQ ID NO: 232 | FabH | >gi\|374851360\|dbj\|BAL54322.1\| 3-oxoacyl-[acyl-carrier-protein] synthase III [uncultured *Aquificae bacterium*] | MGTTLTGIGYYLPPKVLTNFDLEKMVDTSD DWITTRTGIKERRIADNENVTQMAYMASLE ALESANIQPEDIDLIILATLTPELKFPSTACLL QAKLGAKRAYAFDISAACSGFIYGLELADAY IKSGKAKKILLVGAERLSEIVNWQDRSTCVL FGDGAGAVIISEGDGEVLSSKMLSDGELWEI LYAPKCGYINMKGKELFKLAVRSMEEVCRY VLESAGISIEDVSIMIPHQANIRIMEALAEKLG MPKEKVYSNIHKYGNTSAASIPIAMYEAYKE GKLRRGDIVMLTAMGGGLTWGAALLRF |
| SEQ ID NO: 233 | FabH | >gi\|381164912\|ref\|ZP_09874142.1\| 3-oxoacyl-(acyl-carrier-protein) synthase III [*Saccharomonospora azurea* NA-128] | MTRPTLTLAQGAKASRVLGVGSTQPDRVVT NDELSQHMDTSDQWIRDRVGIIERRFAGEDE RLVDMAVTAGAKALADAGVAPSEVDTVIVP NCTMPAPIPNAAAQVADRIGVKAAGAFDLN AACAGFCYGLGVASDLVRAGSAKKVLVIGA EKLTDVVDPTDRSTAIIFADGAGAALVGPSD EPGIGPVAWGSAGDLVDVIYMRDNRYIFQE GQPVFRWATTQIAPVAMRAVELAGLELSDID VLIPHQANLRIVEAIAKRLRAKGARDDMVV ADDIRYSGNTSSASIPMALDHMRAAGTVKP GDVVLTVGFGAGLSYAGQVLICP |
| SEQ ID NO: 234 | FabH | >gi\|386335197\|ref\|YP_006031367.1\| 3-oxoacyl-ACP synthase [*Ralstonia solanacearum* P082] | MHDVVISGTGLWVAPEVITNEELVASFNAY ARHYNEANATAIAAGTLAAVAESSVEFIEKA SGIRQRYVIDKAGVLDPARMRPRLAPRGDD ALSLQAEIGVAAAREALAAAGRDAGDIDMLI CSAANMQRPYPAMGIEIQNALGADYAFDM NVACSSATFGLEQAINAVRTGSARLAMVN PEITSGHLAWKDRDCHFIFGDVCTAVVERA DDARAPDQWQVLGTRMATRFSNSIRNNAGF LSRSEDRDPDDRDQLFRQEGRKVFKEVCPM AAEHIAGHLQSLGHAPADVRRFWLHQANLG MNQLIGKRLLGRDASADEAPVILDEFANTAS AGSIIAFHRHRADLQPGDLGLICSFGAGYSIG SVAVRKR |
| SEQ ID NO: 235 | FabH | >gi\|392946737\|ref\|ZP_10312379.1\| 3-oxoacyl-(acyl-carrier-protein) synthase III [*Frankia* sp. QA3] | MLGLGVYRPARVVTNDEIAQRVETSDAWIQ SRTGIATRRIADEEETTVAMGAAAAEKALAA AGLTADTIDLVIGATCTSPSQIPGAGPQIAHRI GADQAGAFDINGACAGFSYAVSTAADMVR AGSVRHVLVVATERLSDYTDWDDRSTCILL ADGAGATVIGAAETDEIGPAVWGHDGSRPE AIRVPGYGDNMFRMEGQAVFRWAISLVPTV RQICERAGVAPDELAGIVPHQANLRIVEALA TGIGATNAAVARDVVDSGNTSAASIPLGLAR LLDAGEIRRGDPVLLFGFGAGLTYCGQVVRC P |
| SEQ ID NO: 236 | FabH | >gi\|397172008\|ref\|ZP_10495404.1\| 3-oxoacyl-(acyl carrier protein) synthase III [*Alishewanella aestuarii* B11] | MQQVVISGSGLFTPQHIISNDELVVSFNQYV DQFNTEHAAQIAAGELAALEYSSSEFIEKASG IKARHVLYKDGILDPKVMHPVFRKRGEDELP EMVEMAVQAATQALAQANKTAADIDLIICA ASNMQRPYPALSVELQQALGAGGYAFDMN VACSSATFAISNAVNAIRGGSAKVVLVVNPE FASPQVDYRSRDSHFIFGDVCTATIIEAESSCT SSQAFRILGMRLKTTFSNNIRCDIGYTEHCFS EQDPKAPFFKQQGRKVFKELLPIVAEVILDE MAAQQVTADDLKRLWLHQANINMNIFAAK KILGRDPLPEEAPLVLDTYANTASAGSIIAFH KYQQGLQSGDKAILCSFGAGYSVGCLVLEK C |
| SEQ ID NO: 237 | FabH | >gi\|399047091\|ref\|ZP_10739223.1\| 3-oxoacyl-(acyl-carrier-protein) synthase III [*Brevibacillus* sp. CF112] | MRQMDKKRSVGILATGSYTPDRVLSNFDLE KMVETTDEWIVSRTGIRERRICSAEQASSDL AYEAAKKALERANISAEQLDMIIVATVTPDM MFPSTACILQEKLGAKRAAALDVSAACTGFL YGITTAAQFIANGLYKYVLVVGVETLSKITN YKDRNTCVLFGDGAGAVIGEVREGFGFQS FELGADGAGGELLCLPAGGSRIPASSESVEN NLHYLSMAGGEVFKAVRVMNSATEAVLSK AGVERENIDLLVPHQANKRIIDSAVQRFGLSE |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | | DKVAINLDRYGNMSSASIPVALDEAIAAGRV KEGDNVILVGFGGGLTWGATLLKWSTTPAE GSGQ |
| SEQ ID NO: 238 | FabH | >gi\|402823152\|ref\|ZP_10872590.1\| 3-oxoacyl-(acyl carrier protein) synthase III [*Sphingomonas* sp. LH128] | MIRSVLIGTGSALPRNAVSNAELAERVDTSD EWIVERTGISNRHIAEEADETTSSLATEAGRKA IEAAGIDAESIDLIVLATATPDQTFPASATIVQ SRLGCRAGGIAFDVAAVCSGFLYAVGVADS MLRTGMARRALVIGAETFSRILDWEDRTTC VLFGDGAGAVVLEAQEQVGETPRGILATRL HADGAHNQLLFVDGGPSTTGTVGKLRMKG REVFRHAVVNLAEVLREVIEEAGLSTSDIDW LVPHQANARILDATAKKLSLPPEKVVMTVG QHANTSAASVPLALDVAVRDGRIKQGDLVM LEAMGGGFTWGASLIRI |
| SEQ ID NO: 239 | FabH | >gi\|407684813\|ref\|YP_006799987.1\| 3-oxoacyl-ACP synthase [*Alteromonas macleodii* str. 'English Channel 673'] | MSQQVVISGVGVWHPKDSITNEELVDSYNA YVDAFNEENKAQIESGDVAAMPYSSAEFIEK ASGIKSRYIYQKEGALDITRMKPKIAPRADDE LSHQAEIAVEAAKLALASANVTADEIDAVIV SCAYTQRAYPAIAIEVQEALNIEGFGFDMLV ACSAATFGMHRAYEMLSAKNATRVLVINPE LVSPQINYADRDSHFIFGDVATATVLELAET AKSEHVYDVLSTKALTKFSNNIRSNFGYMTR AEDVDPYGPDKLFHQAGRKVFKEVCPLAAA HIEAHLASHDITPEGVKRWWLHQANINMNT LICKRLLGRDADRTEAPIVLDEYANTASAGS VIAFGLNHEDLVAGDVGVLCSFGAGYSIGSL VIRKR |
| SEQ ID NO: 240 | FabH | >gi\|410479651\|ref\|YP_006767288.1\| 3-oxoacyl-(acyl-carrier-protein) synthase III [*Leptospirillum ferriphilum* ML-04] | MTPTMLNRSIILGTGSFAPANVLTNEDISRKV ETSDLWIRERTGIRERRIASSGESTSDLALEA GRNALRNAALSPADLDGIIVATATPDLTFPST ACLVQARLGIPGTFAFDVNAVCSGFMYALKI ADSMIRSGQCETLLVIGAEVMSRFVDWSDRS TCILFGDGAGAVVLGKSGSPQTGGVGTVTL HADGRYWDLIHVPGGGSRSPVETEKPPGNA CTIRMKGSETFRMAVRSLEESVREVLKEEGI GVNELDWVVPHQANIRILEALSERLGIPLGH FVVNIDRYGNTSAASIPMALDEAVQDKRIQP GHRILLTAFGSGVTWGSGLVHWTQKAGGDR |
| SEQ ID NO: 241 | FabH | >gi\|410617776\|ref\|ZP_11328741.1\| 3-oxoacyl-[acyl-carrier-protein]synthase 3 protein 1 [*Glaciecola polaris* LMG 21857] | MNSRIIGTGSYYPSEVRTNADLSLMVDTSDE WITDRTGIKERRIIGADETAASMGVEASKKA LEAAGIDAKSLDMIVCATTSGRYALPSTACEI QKALDIDGIPAFDVAAACAGYCYALSVADQ YIKSGMAKRILVVGTDCLSRMISPEDRTMVI LFGDAAGATIIEASEEPGILSTHIHAAGSYGD LLAIGNPTRGDEASIHENWGSMKGNEVFRV AVTKLSEVVEETLAANNMQKSDLDWLVPH QANFRIIKATAKKLNMSLDQVVLTLERYGNT SAATVPTALDEAIRDGRIKRGQNLLLEAFGG GFAWASALVRY |
| SEQ ID NO: 242 | FabH | >gi\|417318270\|ref\|ZP_12104859.1\| 3-oxoacyl-(acyl carrier protein) synthase III [*Listeria monocytogenes* J1-220] | MDTSDEWIRTRTGIEERRIARDDEYTHDLAY EAAKVAIKNAGLTPDDIDLFIVATVTQEATFP SVANIIQDRLGAKNAAGMDVEAACAGFTFG VVTAAQFIKTGAYKNIVVVGADKLSKITNW DDRTTAVLFGDGAGAVVMGPVSDDHGLLSF DLGSDGSGGKYLNLDENKKIYMNGREVFRF AVRQMGEASLRVLERAGLEKEDLDLLIPHQ ANIRIMEASRERLNLPEEKLMKTVHKYGNTS SSSIALALVDAVEEGRIKDNDNVLLVGFGGG LTWGALIIRWGK |
| SEQ ID NO: 243 | FabH | >gi\|417747984\|ref\|ZP_12396438.1\| 3-oxoacyl-(acyl-carrier-protein) synthase III [*Mycobacterium avium* subsp. *paratuberculosis* S397] | MKQIAATSGPTNIGLLSVGSYRPQRVVTNDE LCQNIDSSDEWIYSRTGIKTRRFAARDESTAS MATEAGREAIAKAGLEASDIDCVVVATSTHF LQTPACGPAVAAALGATGVPAFDISAGCAGF GYALGVAADMVRGGTAGKVLVLGSEKLSP TVDMTDRSNCFIFADGAAGVVVGETPTQGIG PTVWGSDGTQATAIRQDIDWMDYLDRPTGP RPFLRLEGSAVFRWAAFEMGKVGQQAMDA AGVRPDEIDVFLPHQANSRINEILAKSLELRP |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | | DAVIANDIEHTGNTSAASIPLAMAEVLATGA AKAGDLALLIGYGAGLSYAAQVVRLPPG |
| SEQ ID NO: 244 | FabH | >gi\|422338672\|ref\|ZP_ 16419632.1\| 3-oxoacyl-(acyl-carrier-protein) synthase III [*Fusobacterium nucleatum* subsp. *polymorphum* F0401] | MQSIGIKGIGYYVPENVFTNFDFEKIIDTSDE WIRTRTGIVERRFASKDQATSDLAREEAALKA IENAKIKKEDVDMIILATTTPDYIAQGAACIV QNKLGLTSIPCFDLNAACTGFIYGLEVAYSL VKSGLYKNVLVIGAETLSRIIDMQNRNTCVL FGDGAAAAIVGQVEEGYGFLGLSIGAEGEDD MILKVPAGGSKKPNDEETIKNRENFVIMKGQ DVFKFAVSTLPKVTLDALEKAKLDVNDLSM VFPHQANLRIIESAAKRMKFPLEKFYMNLSR YGNTSSASVGIALGEAVEKGLVKKGDNIALT GFGGGLTYGSAIIKWAY |
| SEQ ID NO: 245 | FabH | >gi\|443491493\|ref\|YP_ 007369640.1\| 3-oxoacyl-[acyl-carrier-protein]synthase III, FabH_1 [*Mycobacterium liflandii* 128FXT] | MEHRPECCCGCALAQMPSPPEESVPLPPTVG ILGTAAFVPPRVVTNNQAGASAGIDDAWIFA RTGIRTRRWADPEQATSDLAVQAAEQALAN TAINAGQLGAIIVSTSTPDQPQPPTAAFVQNA LHANSAYAFDTNAVCSGFLFAINTAHALAQ RDSIHVLVIGADVYSRILDPTDRKTVCLFGD GAGAVVVGPTTASSRHLRIVDTELHTFTQHI NLIGVPGGGSRQPLTTATLDAGQHYFHMDG RGVRDFVTTTVPEQVRKFLARHHLAVEDID HVVMHQANGRMLDEIYSLLDLRNATCHQTI DRFGNTGSASIPITLHHAYPELHGNILCIGFG GGMAAGITLLAAASGSAGDVGAHK |
| SEQ ID NO: 246 | FabH | >gi\|474659331\|emb\|C CV14840.1\| Beta-ketoacyl-acyl-carrier-protein synthase I [*Mesorhizobium* sp. STM 4661] | MHRVIISGLGVEIPEPSITNEELVASFNAWVD TENVRRQASGEAPLAKSDSAFIVHASGVQTR HVIEREGILDPTRMAPRIPARPDDALSLQAEF GIASARKALDHAGLKPSDIDLVICSSSHQQRP YPAIAIEMQEALGTKGAGFDMGLGCSSAAA ALHMAVNLVRSGAHKRVLVTTPEIITGHLNF RDRQTHFIFGDASVSMIVEGLAKGDKRPGRF EVLDTRIWTQMSNNIRTNLGYHTRTAQDDP YMINLEGNLIKQVGNKVFKEVTVAGHKFIVE FLAEHGLTPEAIRRFWLHQANARMNAMILK LSFGHEVGHDRAPMVLERLGNTAGAGAIIAL SENHADMKPGDFGLLCAFGAGYSIGGALLR ML |
| SEQ ID NO: 247 | FabH | >gi\|21224866\|ref\|NP_ 630645.1\| 3-oxoacyl-ACP synthase [*Streptomyces coelicolor* A3(2)] | MHQGSRITAVGHYQPARILTNEDLAGMVDT SDEWIRSRVGIRTRRIAGPDEPVDELAGHAA AKALASAGLTPADVDLVVVATSTAIDRSPNT AARVAARLGIPGPAALDLNVVCAGFTHALA TADHAVRAGSASRALVVGADKMSEVVDWT DRTTCVLVGDGAGAAVVEACAPGEEPIGIP VLWGSVPEMGNAVRIEGTPPRFAQEGQSVY RWATTRLPAIARQACERSGLEPADLAAVVL HQANLRIVEPLAAKIGAVNAVVARDVVESG NTSAASIPLALSKLAERGEITTGDPALLFGFG GNLSYAGQVVRCP |
| SEQ ID NO: 248 | FabH | >gi\|239623103\|ref\|ZP_ 04666134.1\| 3-oxoacyl-[acyl-carrier-protein]synthase III [*Clostridiales bacterium* 1_7_47_FAA] | MTTRIIGTGSYVPEQIVTNNDLAQIVETNDE WIRSRTGIGERRIATTESTSYMAANAAMRAL EQSGVKPEEIDLILLGTSSPDYCFPNGACEVQ GMIGAVNAACYDISAACTGFVYALNTAHAFI SSGIYKTALVIGSDVLSKLIDWTDRGTCVLFG DGAGAVVVKADETGILGINMHSDGTKGNVL TCGSRTNGNFLLGKKPELGYMTMDGQEVFK FAVRKVPECIKQVLDDAGVAAAEVRYFVIH QANYRIIESIAKRLKVSVDCFPVNMEHYGNT SGASVPLLLDEINRKGMLESGDKIVFSGFGA GLTWGATLLEW |
| SEQ ID NO: 249 | FabH | >gi\|254477647\|ref\|ZP_ 05091033.1\| 3-oxoacyl-(acyl-carrier-protein) synthase III [*Ruegeria* sp. R11] | MTRRAVIAGIGHYLPERIVENAEFEATLDTSD EWIRSRSGIERRHFAAEGETTSNMATKAAQN ALADAGMTADDIDAIVVATSTADLTFPSAAT MVQAQLGMTKGPAFDVQAVCAGFVYALSN ANALVASGQADKVLVIGAETFSKIMDWTDR STCVLFGDGAGALVLEAQEGAGTSDDRGIL ATDLNSDGRFKDLLYVDGGVSTQNTGHLRM QGNQVI-RHAVEKLASTAHTSLERAGLGADD VDWIVPHQANIRIIQGTAKKMGLPMDKVVV |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | | TVQDHGNTSAASIPLALSVGKARGQIKQGDL IVTEAIGGGLAWGSVVLRW |
| SEQ ID NO: 250 | FabH | >gi\|311113478\|ref\|YP_ 003984700.1\| 3-oxoacyl-(acyl-carrier-protein) synthase III [Rothia dentocariosa ATCC 17931] | MTTLKQYENNRYSRILGYGASRGEVIVHNN DIVEAINSSDEWIKQRTGISTRHRASENQTVN DLAIAAAHDALANSHVTGEQIDAVIISTISHP YATPSLAVLVADAIGSRCPAYDISAACAGFC YGIAQADAMVRSGMAQNVLVIGVEKLSDFI DNTERSISFLLGDGAGAAVVSVSDEPGIAPTI WGSDGSRWGTVGMTHSLLDIRNRDFVVNPV QEDEKIWPTLRQDGPSVFRWAVWEMAKVA QQALESAGITPDELGALIPHQANARIIDQMA KTLKLPENVAIARDIADAGNTSAASVPLAAH RLLQEQPELSGKFALQIGFGAGLAYAAQVV VLP |
| SEQ ID NO: 251 | FabH | >gi\|312793335\|ref\|YP_ 004026258.1\| 3-oxoacyl-(acyl-carrier-protein) synthase iii [Caldicellulosiruptor kristjanssonii 177R1B] | MKQNVKILSTGRFVPEKILSNYDLEKMVETS DEWITQRTGIKERRIVDGRTSTTDLAVQAAR NAMQKAGISPDEIDLVIVATVTPEMFFPSTAC LVQKELKLKNAFAFDISAACSGFIYGMAVAT QFIQNGFCKTALVIGAEALSKITNWSDRSTC VLFGDGAGAAILTASSEEGILGFELGSDGEN GLLLYCHAFGLSDLSYSQFKDMPNFRKIYM DGNEVYKFAVKIMPYAVEKVLEKVGLSSSDI DVFIPHQANIRIIESAAKRLKIPMEKVFVNLH KYGNTSAASIPIALDEAIEEGRIKKGDRIVLV GFGGGLTWASCAVKWI |
| SEQ ID NO: 252 | FabH | >gi\|320449672\|ref\|YP_ 004201768.1\| 3-oxoacyl-ACP synthase [Thermus scotoductus SA-01] | MSGILALGAYAPERVMKNEEFEAYLDTSDE WIVTRTGIRERRIAAEDEYTSDLAFKAVEDL LGRHPGALEGVDGVIVATNTPDALFPDTAAL VQARFGIQGFAYDLLAGCPGWLYALAQAHA MVEAGLARKVLVVGAEALSKIVDWNDRAT AVLFGDAGGAAVVGKVSKGFGFRSFVLGAD GTGAKELYHACVAPRLPDGTSMRNRLYMN GREVFKFAVRVMNTATLEAIEKAGLTPEDIK VFVPHQANLRIIDAARERLGLPWERVVVNV DRYGNTSTASIPLALKEAVDEGRIREGDHVL LVSFGAGLTWAAAVITWGGA |
| SEQ ID NO: 253 | FabH | >gi\|322421910\|ref\|YP_ 004201133.1\| 3-oxoacyl-(acyl-carrier-protein) synthase III [Geobacter sp. M18] | MIRAEILGTGGFVPARVVPNAHFNYLVDDA DQWIHSRTGIRERRFASAEEATSDLATNAAL LALENGVDVDPLEIDCIIVSTSTPDMILPATAC MVQKNIGAAKAFAFDMNAVCSSFIYGMEVA DNLIRSGKYRKVLLIGADTYSKILDFDDKGS APLFGDGAGAVILGAGLSGKGILQSVMHSD GNGWELIQVPSSGSRKPVTAESIAAKENTFK MAGKSVFTFATDVIPRIISDLAERGGIRAEDI DHIIPHQANVRIIDFISRKTGIPKEKFLLNLDR YGNTAAASVGLALDENRRNGVIKSGELVLM MGFGGGLSWGGVLLKA |
| SEQ ID NO: 254 | FabH | >gi\|325677042\|ref\|ZP_ 08156713.1\| 3-oxoacyl-(acyl-carrier-protein) synthase III [Rhodococcus equi ATCC 33707] | MPAPIATATPAAHAALLGLGVYRPRRVVPNS EIVDRIDSSDEWIRTRSGITARGWAEPDETIV SMSVAAARDALAAAGLVAEQIDAVVLATSS QMVLGPSAGAVVATELGMQDTAAFDISAGC AGFCYALGNAASLVRAGQARHVLVIGVERL SDLLDPTDRTCAFIFADGAGAVVVGPSDSEG IGPVAWGSDGSQTKAIKQDKDFMQYFAEVA AAEEAAGGSTERPYIRMDGQAVFRWAITFLE KACRDALEKAGVTADDLDAFVPHQANSRIT DALIRTLGLPDSVAVARDIAESGNTSAASIPM AMEQLLRSGEARPGDTALLLGFGAGLAYAG QVVQLPAIS |
| SEQ ID NO: 255 | FabH | >gi\|326203621\|ref\|ZP_ 08193485.1\| 3-oxoacyl-(acyl-carrier-protein) synthase III [Clostridium papyrosolvens DSM 2782] | MIKSTKSVGIIGTGSFVPEKVLTNNDLEKMV DTSDEWIIKRTGISERRILDHDTPNYTMGIEA ANRALEDAGLKAEDIDLLILSTEAPDYMSPS MSCIIQGAIGAVNAIAFDLNAACTGFIYSLSV ARQFIANGVYRNALVIGCEGLSKIVDWKDR NTCILFGDASGAVVLGEVDEGYGILDSFLGS NGAEGMNITIPNLYLSEEEKAKRVNEKYNTL WMDGKEVFKFAVKAMSSATMHVLDNLNM DIKELDFIFPHQANTRIIDGAIKKLGITDDKIH |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | | YIINKYGNISSASIPVAMDEAKRDGKLKKGD NMVLVAFGGGLTWGSMAVKWSK |
| SEQ ID NO: 256 | FabH | >gi\|332670773\|ref\|YP_ 004453781.1\| 3-oxoacyl-(acyl-carrier-protein) synthase III [*Cellulomonas fimi* ATCC 484] | MTRPTLTQATGPAHSRILGIGGVRGERVVPN DDLVGPIDSSDEWIRQRTGIVTRRRAGEGTD VLDLAEGAARAAIENAGLTGADIDAVILSTV TYFHQTPAGAAIIADRIGATPAAAYDISAACA GYCYGIGQADALVRAGAARHVLVIGAEKMS EFVDPTDRSISFLLGDGAGAVVIGPSDTPGIG PTVWGSDGAQAQAIRQTHSWLATRDEGAG WPTLRQEGQSVFKWAVWQMAPVAQKALD AAGVTADQIDAFVPHQANMRIIDQMIKQLKL PETVVVGRDIADTGNTSAASIPLATERLLREG QVSSGALALQIGFGAGLVYAAQVVVLP |
| SEQ ID NO: 257 | FabH | >gi\|340361349\|ref\|ZP_ 08683778.1\| 3-oxoacyl-[acyl-carrier-protein]synthase III [*Neisseria macacae* ATCC 33926] | MQYAKILGTGSYLPANRVSNDDLAKKVDTS DEWITTRTGIKFRHIADEGEKTSDLAAEASRR ALVAAGVTADEIDLIIVATATPDMQFPSTATI VQQKLGIANGCPAFDVQAVCAGFMYALSTA NAYIKSGMAKKALVIGAETFSRIVDWNDRTT CVLFGDGAGAVVLGASDEAGIIHSKLKADG NYLDLLNVPGQIANGQVCGSPYITMDGPVF KFAVKMLAKIADEVISEAGYTPDQIDWLVPH QANKRIIDSTAKHLGLDMEKVILTVQEHGNT SAASIPLALDVGIQNGQIKRGQNLLLEGIGGG FAWGAVLVKY |
| SEQ ID NO: 258 | FabH | >gi\|345304635\|ref\|YP_ 004826537.1\| 3-oxoacyl-ACP synthase III [*Rhodothermus marinus* SG0.5JP17-172] | MPYAAITAVGHFLPEDRLTNADLEKMVDTS DEWIRTRTGIRERRILRDPNKATSYMATEAA RECLRKRGMDPEDVELIIVATVTPDMFFPAT ACLVQANLGARNAWGFDLSAACSGFLFALS TAARFIESGKHKRVMVIGADKMSTITDYTDR KNCILFGDAAAAVLLEPDPECGVIDSVEHCD GNNWELLCMLGGGSLNPPTHETVDRKMHY LHQEGRAVFKLAVEGMAQVAVEIMERNNLT ADDVRYLVPHQANLRIIDATARRMGLSPDK VMVNIDRYGNTTAATIPLCLYDWERQLRRG DNLILAAFGGGFTWGAIYLKWAYDGDKVA AAAEATAETSTENA |
| SEQ ID NO: 259 | FabH | >gi\|349685677\|ref\|ZP_ 08896819.1\|3-oxoacyl-[acyl-carrier-protein]synthase III [*Gluconacetobacter oboediens* 174Bp2] | MTAKRSLLSGFGGYLPERIVTNDELASRLDT SDEWIRGRTGIGQRHIAGENDTAVSMAAQA ARRALDYAGAAPDDVDAIIVATSTPDQAFPS TAVRVQAELGMTSGFGFDLAAACSGFIYALS MADSLIRSGQARSALVIGSEVYSRILDWSDR GTCVLFGDGAGAAFLTAAGPDDGDAGILST HLHSDGQYGDLLYVDGATGQHDRPAHLRM QGRDVFRHAVGKLSASVDEALAANNLSHAD VNWLVPHQANLRIIDGVARKLALPAERVVV TVDRHANTSAASIPLALNEAVRDGRIRKGDL VLMEALGGGLTWGSALVRL |
| SEQ ID NO: 260 | FabH | >gi\|352106212\|ref\|ZP_ 08961263.1\| 3-oxoacyl-(acyl carrier protein) synthase III [*Halomonas* sp. HAL1] | MTHVVITGTGLYTPEHAIDNAALVAAFNAW VDGENEQHAEAIERGEREPLANSSSEFIEKAS GIKSRYVLDASGILDPQRMRPKLPQRSNDEP SLQCEMATEAAHQALAAAQVDAADIELVIV ACSNLERAYPAVAVEVQQTLGTSGYGFDMN VACSSATFALETAANAIASGSVNRALVVNPE ICSAHLNFRDRDSHFIFGDACTAVVLENSAV AVADEQFEILGTRLVTKFSNAIRNNAGFLNR VTDSDPMALDKLFVQEGRRVFKEVCPMVAK LITDHLASLELNGSDLKRMWLHQANRHMN DLIARKVLGYDPSETQAPIILDRYANTSSAGS IIAFHLHREQFNQGDIGVICSFGAGYSAGSVV IRRV |
| SEQ ID NO: 261 | FabH | >gi\|375098553\|ref\|ZP_ 09744816.1\| 3-oxoacyl-(acyl-carrier-protein) synthase III [*Saccharomonospora cyanea* NA-134] | MSTQDARGVAVLAGLGGWLPPRVVDNDEL SRRLDTSDEWIRTRTGIAKRHVVHTGLSTVD MAVEAGRRALESAGPYGENVDAVVLATSTP DHVCPASAPQVAAELGLSGAAAFDVNAVCS GFVYALATASGLISGGVAKRVLLVGADAFT TLLDPDDRTTVPIFGDGAGAVVLREGSADEL GAVGPFDLHSDGELAELLIVPAGGSRRKKSE NASDHFLKMQGPAVFRHATARMASSSRAVL EKAGWTTSDVDRFVGHQANVRILTATAKNL |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | | GLPADSLVVNIGHTGNTSAASIPLAMVDAAV DGMLQPGDRVLVTAFGAGLTWGSTVLRWP ELACAPLP |
| SEQ ID NO: 262 | FabH | >gi\|384154990\|ref\|YP_ 005537805.1\| 3- oxoacyl-ACP synthase [Arcobacter butzleri ED-1] | MIYAAFRSIGAYIPPKIMSNADFEKIIDTSDE WITKRTGIKERRIANEGEASSDLGARAGELAI ERAGISKEEIDLVICATVTPDFLCMPSTACLIA AKLGLPNVMAFDVSAACTGFVYALNVAKA FIESGMKKNVLIVGAEKYSAILDYTDRTTCFL FGDGAGAAIISATNDKNESIIDINCSSDGNYE DLIKTPGGGSKNPCSQEVLENKMACIKMKG NETFKLAVKTLTSDVKTMLEKHNLTNEDIN HFIPHQANYRIIKAVGEALDLSDEKTVVTVD KYGNTSAASIPMAMNYAFEQGKIKAGDTILF DAFGGGLTWGSALFKFAPIKR |
| SEQ ID NO: 263 | FabH | >gi\|385331603\|ref\|YP_ 005885554.1\| 3- oxoacyl-ACP synthase [Marinobacter adhaerens HP15] | MIKAVISGTGLYTPPATISNDELVEAFNQYVE LFNAENADAIASGDVTPLQPSSSSFIEKASGIK RRHVIDKDGILDPNRMKPYIPDRSNEEPSVQ CDMAVTACREALEQAGKSAEDVDAVIVACS NLQRAYPAVSIEVQEALGIDGFAYDMNVAC SSATFGLQAAVNSVENGSARAVLVVSPEICS GHLNFRDRDSHFIFGDACTAILVEREEDTRE GQGFEILGTSLKTKFSNNIRNNFGFLNRADES GVGKPDKLFVQQGRKVFKEVSPLVAETIQK QLQSLSLAPDDLRRMWLHQANLNMNQLIAR KVLGRDATEEEAPVILDEYANTSSAGSIIAFH KNKDDLVSGDLGVICSFGAGYSIGSVVVRRR |
| SEQ ID NO: 264 | FabH | >gi\|400755130\|ref\|YP_ 006563498.1\| 3- oxoacyl-[acyl-carrier- protein]synthase 3 [Phaeobacter gallaeciensis 2.10] | MFTPAITGTGVFTPSQTITNAELVAAFNAYA DKTNAENAKAIAAGEMEPLAHSSEEFILKAS GIEQRYVMDKSGVLDPEVMHPLLRQRGDDE PSIMAEMALDAAKKALAQAGKTAADVDTVI CAASNMERAYPALAIEIQDLLGIKGFAFDMN VACSSATFGIQAAADMVRSGSIRSALVVNPEI CSGHLEWRDRDCHFIFGDVATATLIERSEDA TGAYFEILSTRCATSFSNNIRNNNGYLRRSRP DGVEDRRDMQFMQNGRKVFKEVLPMVSQH IAEHMEAEGVSNTDLKRLWLHQANKTMND FIGKKVLGRTPEAGEQPNILQDYANTSSAGSI IAFSKYSDDLSAGDLGLICSFGAGYSVGSVIL RRVA |
| SEQ ID NO: 265 | FabH | >gi\|423197564\|ref\|ZP_ 17184147.1\| hypothetical protein HMPREF1171_02179 [Aeromonas hydrophila SSU] | MTSIVISGSGLYTPPFAVSNEALVAAFNQYV DLYNEENASAIDAGQLPAKQHSSSEFIEKAS GIKSRYLVSKEGVLDPDIMQPLLAERPDDKP SIMVEMAVAAAEQALIAAGREPGEIDLVIVA ASNMPRPYPALSIELQHYLGASGMAFDMNV ACSSATFGIKTAADMLAAGSARLALVVNPEI CSGHLNFRDRDSHFIFGDACTAVLLEREADC QVANPWQLVASKLVTQYSNNIRNNFGFLNR LSPRTRYGDDKLFRQQGRKVFKEVLPLVCD QIAGQLDEQGWAADSLSRLWLHQANLTMN QFIARKLLGHDASQQEAPVILDSYGNTSSAG SIIAFHLYNRDLPAGARGVLCSFGAGYSIGSL LLRRL |
| SEQ ID NO: 266 | FabH | >gi\|424853848\|ref\|ZP_ 18278206.1\| 3- oxoacyl-[acyl-carrier- protein]synthase [Rhodococcus opacus PD630] | MGKQIATVAGGRQSALLGLGVYRPERVVTN DEICELIDSNDEWIQSRSGIRNRRFAAEDENV VTMSIAAGRKAIEASGIDPEQIGCVIVATSTY LLLTPPAAAVVADALGTNGPGAFDLGGGCA GFCTALTVASDLVRGGSVDYALVVGVEKMS ITTDPTDRSTRFIFGDGAGAVVVGKSDVAGI GPVEWGSDGAQADAIVQDLDWYEYITTPGA TRPYIKMAGTAVFRWAAFEMGKVALRAVE KAGMSVDDLDAFVPHQANSRITEVIARSMK LPENVPVSDDIAESGNTSAASVPLAMEEMLQ SGATKPGDTALLLAFGAGLSYAAQVVTMPV LAKD |
| SEQ ID NO: 267 | FabH | >gi\|441509582\|ref\|ZP_ 20991498.1\| 3- oxoacyl-[acyl-carrier- protein]synthase III [Gordonia aichiensis | MSVIAANTGHQNVAMLGIGAYRPQRLVSND EVCEVLDSSDEWIFERSGVRNRRWISGDESA RSMAAAAERAIENSGIAKEKIGALILATNS WKTKIPHGGPIVAYDIGLNGIPAYDIAAGCG GFGYALGVAADTVRAGSAEYVLVVGVETM |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | NBRC 108223] | SVVMEPTDRNTAFIFGDGAGAVVVGPSEAN GISPTVWGSDGENAEAIGQNYDIPEYMDRAQ EYQHKDPETDPVGRMVVTMQGPRVFRWAA ITLPKALTSVIERSGISADDIEVFVPHQANARI NELMKKNLGFPDDMPMANDIENTGNTSAAS IPLAMEEMLATGKAKGGQTALLLGFGAGLS YAGAVVTLPPAPKVSSFDDLG |
| SEQ ID NO: 268 | FabH | >gi\|47987537\|gb\|EN U26638.1\| hypothetical protein F992_02187 [*Acinetobacter* sp. NIPH 236] | MGIRITGTGLFHPTESISNEELVESLNAYVEQ FNQENAEQIAAGEIEALRGSSPEFIEKASGIQR RYVVEKSGILDPKRLRPRLQERSNDELSLQA EWGVIAAKQAMENAGVTAEDIDVVILACSN MQRAYPAVAIEIQSALGIQGYAYDMNVACS AATFGLKQAYDAVKCGARRVLLLNVEITSG HLDYRTRDAHFIFGDVATASIIEETETKSGYE ILDIHLFTQFSNNIRNNFGFLNRSEDAVVDDK LFRQDGRKVFKEVCPLVAKIITAQLEKLELTP EQVKRFWLHQANANMNELILKLVVGKEAD LERAPIILDEFANTSSAGVIIAMHRTGEQVNN GEYAVISSFGAGYSVGSIIVQKHIA |
| SEQ ID NO: 269 | PaFabG | >gi\|15598163\|ref\|NP_ 251657.1\| 3-ketoacyl- ACP reductase [*Pseudomonas aeruginosa* PAO1] | MSLQGKVALVTGASRGIGQAIALELGRLGA VVIGTATSASGAEKIAETLKANGVEGAGLVL DVSSDESVAATLEHIQQHLGQPLIVVNNAGI TRDNLLVRMKDDEWFDVVNTNLNSLYRLS KAVLRGMTKARWGRIINIGSVVGAMGNAG QTNYAAAKAGLEGFTRALAREVGSRAITVN AVAPGFIDTDMTRELPEAQREALLGQIPLGR LGQAEEIAKVVGFLASDGAAYVTGATVPVN GGMYMS |
| SEQ ID NO: 270 | fabG | >gi\|150963085\|gb\|AB R85110.1\| 3-oxoacyl- (acyl-carrier-protein) reductase [*Pseudomonas aeruginosa* PA7] | MSLQGKVALVTGASRGIGQAIALELGRLGA VVIGTATSASGAEKIAETLKANGVEGAGLVL DVSSDESVAATLEHIQQHLGQPLIVVNNAGI TRDNLLVRMKDDEWFDVVNTNLNSLYRLS KAVLRGMTKARWGRIINIGSVVGAMGNAG QTNYAAAKAGLEGFTRALAREVGSRAITVN AVAPGFIDTDMTRELPEAQREALLAQIPLGR LGQAEEIAKVVGFLASDGAAYVTGATVPVN GGMYMS |
| SEQ ID NO: 271 | hbd | >gi\|20162442\|gb\|AA M14586.1\|AF494018_ 5 3-hydroxybutyryl- CoA dehydrogenase [*Clostridium beijerinckii*] | MKKIFVLGAGTMGAGIVQAFAQKGCEVIVR DIKEEFVDRGIAGITKGLEKQVAKGKMSEED KEAILSRISGTTDMKLAADCDLVVEAAIENM KIKKEIFAELDGICKPEAILASNTSSLSITEVAS ATKRPDKVIGMHFFNPAPVMKLVEIIKGIATS QETFDAVKELSVAIGKEPVEVAEAPGFVVNG ILIPMINEASFILQEGIASVEDIDTAMKYGAN HPMGPLALGDLIGLDVCLAIMDVLFTETGDN KYRASSILRKYVRAGWLGRKSGKGFYDYSK |
| SEQ ID NO: 272 | crt | >gi: 1706153 P52046\|CRT_CLOAB 3-hydroxybutyryl- CoA dehydratase *Clostridium acetobutylicum* | MELNNVILEKEGKVAVVTINRPKALNALNS DTLKEMDYVIGEIENDSEVLAVILTGAGEK SFVAGADISEMKEMNTIEGRKFGILGNKVFR RLELLEKPVIAAVNGFALGGGCEIAMSCD IRIASSNARFGQPEVGLGITPGFGGTQRLSRL VGMGMAKQLIFTAQNIKADEALRIGLVN KVVEPSELMNTAKEIANKIVSNAPVAVKLSK QAINRGMQCDIDTALAFESEAFGECFSTE DQKDAMTAFIEKRKIEGFKNR |
| SEQ ID NO: 273 | ech | >gi\|74484320\|gb\|ABA 10805.1\| enoyl CoA hydratase [*Pseudomonas putida*] | MSDTEVPVLAEVRNRVGHLALNRPVGLNAL TLQMIRITWRQLHAWESDPEIVAVVLRANGE KAFCAGGDIRSLYDSYQAGDDLHHVFLEEK YSLDQYIHGYPKPIVALMDGFVLGGGMGLV QGTALRVVTERVKMGMPETSIGYFPDVGGS YFLPRLPGELGLYLGITGIQIRAADALYARLA DWCLPSERISEFDRRLDQISWGYAPREILAGL LSSLASNRLLGAELKSLHPAIDEHFTQPDLSA IRASLQAERRPEYQDWAEQTVELLNNRSPLA MSATLKLLRLGRTLSLANCFELELHLERQWF AKGDLIEGVRALLIDKDKTPRWNPPTLEQLD TNRVNEFFDGFQPAT |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| SEQ ID NO: 274 | ech2 | >gi\|162287198\|ref\|NP_077368.2\| peroxisomal multifunctional enzyme type 2 [Rattus norvegicus] | MASPLRFDGRVVLVTGAGGGLGRAYALAFA ERGALVVVNDLGGDFKGVGKGSSAADKVV EEIRRRGGKAVANYDSVEAGEKLVKTALDT FGRIDVVVNNAGILRDRSFSRISDEDWDIIQR VHLRGSFQVTRAAWDHMKKQNYGRIIMTAS ASGIYGNFGQANYSAAKLGLLGLANTLVIEG RKNNIHCNTIAPNAGSRMTETVMPEDLVEAL KPEYVAPLVLWLCHESCEENGGLFEVGAGW IGKLRWERTLGAIVRKRNQPMTPEAVRDNW VKICDFSNASKPKSIQESTGGIIEVLHKIDSEGI SQNHTGQVASADASGFAGVVGHKLPSFSSS YTELQCIMYALGVGASVKNPKDLKFVYEGS ADFSCLPTFGVIVAQKSLMSGGLAEVPGLSIN FAKVLHGEQYLELYKPLPRSGELKCEAVIAD ILDKGSGIVIVMDVYSYSGKELICYNQFSVFV VGSSGFGGKRTSEKLKAAVAVPSRPPDAVL RDTTSLNQAALYRLSGDSNPLHIDPSFASIAG FEKPILHGLCTFGFSARHVLQQFADNDVSRF KAIKVRFAKPVYPGQTLQTEMWKEGNRIHF QTKVQETGDIVISNAYVDLVPTSGVSAQTPS EGGALQSALVFGEIGRRLKDVGREVVKKVN AVFEWHITKNGNVAAKWTIDLKNGSGEVYQ GPAKGSADTTITISDEDFMEVVLGKLNPQNA FFSGRLKARGNIMLSQKLQMILKDYAKL |
| SEQ ID NO: 275 | ter | >gi\|488758537\|ref\|WP_002681770.1\| trans-2-enoyl-CoA reductase [Treponema denticola] | MIVKPMVRNNICLNAHPQGCKKGVEDQIEY TKKRITAEVKAGAKAPKNVLVLGCSNGYGL ASRITAAFGYGAATIGVSFEKAGSETKYGTP GWYNNLAFDEAAKREGLYSVTIDGDAFSDEI KAQVIEEAKKKGIKFDLIVYSLASPVRTDPDT GIMHKSVLKPFGKTFTGKTVDPFTGELKEISA EPANDEEAAATVKVMGGEDWERWIKQLSK EGLLEEGCITLAYSYIGPEATQALYRKGTIGK AKEHLEATAHRLNKENPSIRAFVSVNKGLVT RASAVIPVIPLYLASLFKVMKEKGNHEGCIE QITRLYAERLYRKDGTIPVDEENRIRIDDWEL EEDVQKAVSALMEKVTGENAESLTDLAGYR HDFLASNGFDVEGINYEAEVERFDRI |
| SEQ ID NO: 276 | ccr | >gi\|81309006\|sp\|Q53865.1\|CCR_STRCU RecName: Full=Crotonyl-CoA reductase | MTVKDILDAIQSKDATSADFAALQLPESYRA ITVHKDETEMFAGLETRDKDPRKSIHLDEVP VPELGPGEALVAVMASSVNYNSVWTSIFEPV STFAFLERYGKLSPLTKRHDLPYHIIGSDLAG VVLRTGPGVNAWQPGDEVVAHCLSVELESP DGHDDTMLDPEQRIWGFETNFGGLAEIALV KTNQLMPKPKHLTWEEAAAPGLVNSTAYRQ LVSRNGAAMKQGDNVLIWGASGGLGSYAT QFALAGGANPICVVSSPQKAEICRSMGAEAII DRNAEGYKFWKDEHTQDPKEWKRFGKRIRE LTGGEDIDIVFEHPGRETFGASVYVTRKGGTI TTCASTSGYMHEYDNRYLWMSLKRIIGSHF ANYREAYEANRLIAKGKIHPTLSKTYSLEET GQAAYDVHRNLHQGKVGVLCLAPEEGLGV RDAEMRAQHIDAINRFRNV |

Thioesterases

| SEQ ID NO | Enzyme | FASTA Header | Protein Sequence - NCBI Database |
|---|---|---|---|
| SEQ ID NO: 277 | tesA | >gi\|16128478\|ref\|NP_415027.1\| multifunctional acyl-CoA thioesterase I and protease I and lysophospholipase L1 [Escherichia coli str. K-12 substr. MG1655] | MMNFNNVFRWHLPFLFLVLLTFRAAAADTL LILGDSLSAGYRMSASAAWPALLNDKWQSK TSVVNASISGDTSQQGLARLPALLKQHQPRW VLVELGGNDGLRGFQPQQTEQTLRQILQDV KAANAEPLLMQIRLPANYGRRYNEAFSAIYP KLAKEFDVPLLPFFMEEVYLKPQWMQDDGI HPNRDAQPFIADWMAKQLQPLVNHDS |
| SEQ ID NO: 278 | 'tesA | acyl-CoA thioesterase I, cytosolic form | AADTLLILGDSLSAGYRMSASAAWPALLND KWQSKTSVVNASISGDTSQQGLARLPALLK QHQPRWVLVELGGNDGLRGFQPQQTEQTLR QILQDVKAANAEPLLMQIRLPANYGRRYNE AFSAIYPKLAKEFDVPLLPFFMEEVYLKPQW MQDDGIHPNRDAQPFIADWMAKQLQPLVN HDS |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| SEQ ID NO: 279 | tesB | >gi\|16128437\|ref\|NP_414986.1\| acyl-CoA thioesterase II [*Escherichia coli* str. K-12 substr. MG1655] | MSQALKNLLTLLNLEKIEEGLFRGQSEDLGL RQVFGGQVVGQALYAAKETVPEERLVHSFH SYFLRPGDSKKPIIYDVETLRDGNSFSARRVA AIQNGKPIFYMTASFQAPEAGFEHQKTMPSA PAPDGLPSETQIAQSLAHLLPPVLKDKFICDR PLEVRPVEFHNPLKGHVAEPHRQVWIRANG SVPDDLRVHQYLLGYASDLNFLPVALQPHGI GFLEPGIQIATIDHSMWFHRPFNLNEWLLYS VESTSASSARGFVRGEFYTQDGVLVASTVQE GVMRNHN |
| SEQ ID NO: 280 | yciA | >gi\|16129214\|ref\|NP_415769.1\| acyl-CoA esterase [*Escherichia coli* str. K-12 substr. MG1655] | MSTTHNVPQGDLVLRTLAMPADTNANGDIF GGWLMSQMDIGGAILAKEIAHGRVVTVRVE GMTFLRPVAVGDVVCCYARCVQKGTTSVSI NIEVWVKKVASEPIGQRYKATEALFKYVAV DPEGKPRALPVE |
| SEQ ID NO: 281 | ybgC | >gi\|16128711\|ref\|NP_415264.1\| acyl-CoA thioesterase, involved in phospholipid metabolism [*Escherichia coli* str. K-12 substr. MG1655] | MNTTLFRWPVRVYYEDTDAGGVVYHASYV AFYERARTEMLRHHHFSQQALMAERVAFVV RKMTVEYYAPARLDDDMLEIQTEITSMRGTSL VFTQRIVNAENTLLNEAEVLVVCVDPLKMK PRALPKSIVAEFKQ |
| SEQ ID NO: 282 | ybfF | >gi\|16128662\|ref\|NP_415212.1\| acyl-CoA esterase [*Escherichia coli* str. K-12 substr. MG1655] | MKLNIRAQTAQNQHNNSPIVLVHGLFGSLD NLGVLARDLVNDHNIIQVDMRNHGLSPRDP VMNYPAMAQDLVDTLDAQQIDKATFIGHSM GGKAVMALTALASDRIDKLVAIDIAPVDYH VRRHDEIFAAINAVSESDAQTRQQAAAIMRQ HLNEEGVIQFLLKSFVDGEWRFNVPVLWDQ YPHIVGWEKIPAWDHPALFIPGGNSPYVSEQ YRDDLLAQFPQARAHVIAGAGHWVHAEKP DAVLRAIRRYLND |
| SEQ ID NO: 283 | fadM | >gi\|16128428\|ref\|NP_414977.1\| long-chain acyl-CoA thioesterase III [*Escherichia coli* str. K-12 substr. MG1655] | MQTQIKVRGYHLDVYQHVNNARYLEFLEEA RWDGLENSDSFQWMTAHNIAFVVVNININY RRPAVLSDLLTITSQLQQLNGKSGILSQVITL EPEGQVVADALITFVCIDLKTQKALALEGEL REKLEQMVK |
| SEQ ID NO: 284 | AtTE | >gi\|227217220\|gb\|EEI82564.1\| Acyl-ACP thioesterase [*Anaerococcus tetradius* ATCC 35098] | MKFKKKFKIGRMHVDPFNYISMRYLVALMN EVAFDQAEILEKDIDMKNLRWIIYSWDIQIEN NIRLGEEIEITTIPTHMDKFYAYRDFIVESRGN ILARAKATFLLMDITRLRPIKIPQNLSLAYGK ENPIFDIYDMEIRNDLAFIRDIQLRRADLDNN FHINNAVYFDLIKETVDIYDKDISYIKLIYRNE IRDKKQIQAFARREDKSIDFALRGEDGRDYC LGKIKTNV |
| SEQ ID NO: 285 | CpTE | >gi\|1215718\|gb\|AAC49179.1\| thioesterase [*Cuphea palustris*] | MVAAAASSACFPVPSPGASPKPGKLGNWSSS LSPSLKPKSIPNGGFQVKANASAHPKANGSA VTLKSGSLNTQEDTLSSSPPPRAFFNQLPDWS MLLTAITTVFVAPEKRWTMFDRKSKRPNML MDSFGLERVVQDGLVFRQSFSIRSYEICADR TASIETVMNHVQETSLNQCKSIGLLDDGFGR SPEMCKRDLIWVVTRMKIMVNRYPTWGDTI EVSTWLSQSGKIGMGRDWLISDCNTGEILVR ATSVYAMMNQKTRRFSKLPHEVRQEFAPHF LDSPPAIEDNDGKLQKFDVKTGDSIRKGLTP GWYDLDVNQHVSNVKYIGWILESMPTEVLE TQELCSLTLEYRRECGRDSVLESVTSMDPSK VGDRFQYRHLLRLEDGADIMKGRTEWRPKN AGTNGAISTGKT |
| SEQ ID NO: 286 | CperfTE | >gi\|110673483\|gb\|ABG82470.1\| acyl-ACP thioesterase family protein [*Clostridium perfringens* ATCC 13124] | MGKAYEKVYEVTYGET TABLE 14-continued Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| SEQ ID NO: 287 | LpTE | >gi\|28270407\|emb\|CAD63310.1\| oleoyl-[acyl-carrier protein] thioesterase (putative) [Lactobacillus plantarum WCFS1] | MATLGANASLYSEQHRITYYECDRTGRATL TTLIDIAVLASEDQSDALGLTTEMVQSHGVG WVVTQYAIDITRMPRQDEVVTIAVRGSAYN PYFAYREFWIRDADGQQLAYITSIWVMMSQ TTRRIVKILPELVAPYQSEVVKRIPRLPRPISF EATDTTITKPYHVRFFDIDPNRHVNNAHYFD WLVDTLPATFLLQHDLVHVDVRYENEVKY GQTVTAHANILPSEVADQVTTSHLIEVDDEK CCEVTIQWRTLPEPIQ |
| SEQ ID NO: 288 | PA2801TE | >gi\|15597997\|ref\|NP_251491.1\| hypothetical protein PA2801 [Pseudomonas aeruginosa PAO1] | MADRQLLHTAHIPVRWGDMDSYGHVNNTL YFQYLEEARVAWFETLGIDLEGAAEGPVVL QSLHTYLKPVVHPATVVVELYAGRLGTSSL VLEHRLHTLEDPQGTYGEGHCKLVWVRHAE NRSTPVPDSIRAAIA |
| Wax ester synthases | | | |
| SEQ ID NO: 289 | Maq1 | >gi\|120553111\|ref\|YP_957462.1\| hypothetical protein Maqu_0168 [Marinobacter aquaeolei VT8] | MTPLNPTDQLFLWLEKRQQPMHVGGLQLFS FPEGAPDDYVAQLADQLRQKTEVTAPFNQR LSYRLGQPVWVEDEHLEHHFRFEALPTPG RIRELLSFVSAEHSHLMDRERPMWEVHLIEG LKDRQFALYTKVHHSLVDGVSAMRMATRM LSENPDEHGMPPIWDLPCLSRDRGESDGHSL WRSVTHLLGLSGRQLGTIPTVAKELLKTINQ ARKDPAYDSIFHAPRCMLNQKITGSRRFAAQ SWCLKRIRAVCEAYGTTVNDVVTAMCAAA LRTYLMNQDALPEKPLVAFVPVSLRRDDSSG GNQVGVILASLHTDVQEAGERLLKIHHGME EAKQRYRHMSPEEIVNYTALTLAPAAFHLLT GLAPKWQTFNVVISNVPGPSRPLYWNGAKL EGMYPVSIDMDRLALNMTLTSYNDQVEFGL IGCRRTLPSLQRMLDYLEQGLAELELNAGL |
| SEQ ID NO: 290 | Pcry1 | >gi\|93005078\|ref\|YP_579515.1\| hypothetical protein Pcryo_0247 [Psychrobacter cryohalolentis K5] | MRLLTAVDQLFLLLESRKQPMHVGGLFLFEL PEDADISFVHQLVKQMQDSHVPPTFPPFNQVL EHMVFWKKDKNFDVEHHLHHVALPKPARV RELLMYVSREHGRLLDRAMPLWECHVIEGI QPESEGSPERFALYFKIHHSLVDGIAAMRLV KKSLSQSPNEPVTLPIWSLMARHRNQIDAILP KERSALRILKEQVSTIKPVFTELLDNFKNYND DSYVSTFDAPRSILNRRISASRRIAAQSYDIKR FNDIAERINISKNDVVLAVCAGAIRRYLISMD ALPSKPLIAFVPMSLRTDDSVAGNQLSFVLA NLGTHLDDPLSRIKLIHRSMNNGKRRFRRMN QAQVINYSVVSYAWEGINLATGLFPKKQAF NLIISNVPGSEKSLYWNGARLQSLYPASIVFN GQAMNITLASYLDKIEFGITACSKALPHVQD MLMLIEEELQLLEKVSKELEFNGITVEDKSG YKGNGKTKKLAP |
| SEQ ID NO: 291 | Rjos1 | >gi\|111018600\|ref\|YP_701572.1\| hypothetical protein RHA1_ro01601 [Rhodococcus jostii RHA1] | MPVTDSIFLLGESREHPMHVGSLELFTPPEDA GPDYVKSMHETLLEHTDVDPAFRKKPAGPV GSLGNLWWADESDVDLEYHVRHSALPAPY RVRELLTLTSRLHGTLLDRHRPLWEMYLIEG LSDGRFAIYTKLHHSLMDGVSGLRLLMRTLS TDPDVRDAPPPWNLPRRASANGAAPAPDLW SVMNGVRRTVGEVAGLAPASLRIARTAMGQ HDMRFPYEAPRTMLNVPIGGARRFAAQSWP LERVHAVRKVAGVSVNDVVMAMCAGALR GYLEEQNALPDEPLIAMVPVSLRDEQQADA GGNAVGVTLCNLATDVDDPAERLTAISASM SQGKELFGSLTSMQALAWSAVNMSPIALTPV PGFVRFTPPPFNVIISNVPGPRKTMYWNGSRL DGIYPTSVVLDGQALNITLTTNGGNLDFGVI GCRRSVPSLQRILFYLETALGELEAALL |
| SEQ ID NO: 292 | Abork1 | >gi\|110835603\|ref\|YP_694462.1\| acyltransferase [Alcanivorax borkumensis SK2] | MKALSPVDQLFLWLEKRQQPMHVGGLQLFS FPEGAGPKYVSELAQQMRDYCHPVAPFNQR LTRRLGQYYWTRDKQPFDIDHHFRHEALPKP GRIRELLSLVSAEHSNLLDRERPMWEAHLIE GIRGRQPALYYKIHHSVMDGISAMRIASKTL STDPSEREMAPAWAFNTKKRSRSLPSNPVD MASSMARLTASISKQAATVPGLAREVYKVT QKAKKDENYVSIFQAPDTILNNTITGSRRFAA |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| | | | QSFPLPRLKVIAKAYNCTINTVVLSMCGHAL REYLISQHALPDEPLIAMVPMSLRQDDSTGG NQIGMILANLGTHICDPANRLRVIHDSVEEA KSRFSQMSPEEILNFTALTMAPTGLNLLTGL APKWRAFNVVISNIPGPKEPLYWNGAQLQG VYPVSIALDRIALNITLTSYVDQMEFGLIACR RTLPSMQRLLDYLEQSIRELEIGAGIK |
| | | Miscellaneous | |
| SEQ ID NO: 293 | prpE | >gi\|16759349\|ref\|NP_ 454966.1\| propionyl-CoA synthetase [*Salmonella enterica* subsp. *enterica* serovar Typhi str. CT18] | MSFSEFYQRSINEPEAFWAEQARRIDWRQPF TQTLDHSRPPFARWFCGGTTNLCHNAVDRW RDKQPEALALIAVSSETDEERTFTFSQLHDEV NAVAAMLLSLGVQRGDRVLVYMPMIAEAQI TLLACARIGAIHSVVFGGFASHSVAARIDDA RPALIVSADAGARGGKILPYKKLLDDAIAQA QHQPKHVLLVDRGLAKMSWVDGRDLDFST LRQQYLGASVPVAWLESNETSCILYTSGTTG KPKGVQRDVGGYAVALATSMDTIFGGKAG GVFFCASDIGWVVGHSYIVYAPLLAGMATIV YEGLPTYPDCGVWWKIVEKYQVNRMFSAPT AIRVLKKFPTAQIRNHDLSSLEALYLAGEPLD EPTASWVTETLGVPVIDNYWQTESGWPIMA LARALDDRPSRLGSPGVPMYGYNVQLLNEV TGEPCGINEKGMLVIEGPLPPGCIQTIWGDDA RFVKTYWSLFNRQVYATFDWGIRDAEGYYF ILGRTDDVINIAGHRLGTREIEESISGYPNVAE VAVVGIKDALKGQVAVAFVIPKQSDTLADR EAARDEEKAIMALVDNQIGHFGRPAHVWFV SQLPKTRSGKMLRRTIQAICEGRDPGDLTTID DPASLQQIRQAIEE |
| SEQ ID NO: 294 | phaA | >gi\|77464320\|ref\|YP_ 353824.1\| acetyl-CoA acetyltransferase [*Rhodobacter sphaeroides* 2.4.1] | MVIVSAARTAVGSFNGAFASTPAHDLGAAVI EAVVARAGIDKADVSETILGQVLTAGQGQN PARQAHIKAGLPQESAAWSINQVCGSGLRA VALAAQHVQLGDASIVVAGGQENMSLSPHV AHLRAGQKMGDLSFIDSMIKDGLWDAFNGY HMGQTAENVAAKWQISRDMQDEFAVASQN KAEAAQKAGRFADEIVPFVIKTRKGDVTVD ADEYIRHGATLDAMAKLRPAFIKDGTVTAA NASGINDGAAAVLVMSAEEAEKRGLSPLARI ASYATAGLDPSIMGVGPIHASRKALEKAGW KVGDLDLVEANEAFAAQACAVNKDMGWD PSIVNVNGGAIAIGHPIGASGARVLNTLLFEM QRRNAKKGLATLCIGGGMGVAMCLERP |
| SEQ ID NO: 295 | phaB | >gi\|77464321\|ref\|YP_ 353825.1\| 3-oxoacyl-ACP reductase [*Rhodobacter sphaeroides* 2.4.1] | MSKVALVTGGSRGIGAAISVALKNAGYTVA ANYAGNDEAARKFTEETGIKTYKWSVADYD ACAAGIAQVEAELGPVAVLVNNAGITRDSM FHKMTRDQWKEVIDTNLSGLFNMTHPVWS GMRDRKFGRIINISSINGQKGQAGQANYSAA KAGDLGFTKALAQEGARAGITVNAICPGYIA TEMVMAVPEKVRESIIAQIPTGRLGEPEEIAR CVVFLASDDAGFVTGSTITANGGQYFV |
| SEQ ID NO: 296 | phaC | >gi\|28916412\|gb\|AAO 59383.1\| PHA synthase 1 [*Pseudomonas stutzeri*] | MSDKNNEDLKRQASENTLGLNPVIGIRGKDL LTSARMVLAQALKQPFHSAKHVAHFGLELK NVVFGQSELKPEDGDRRFADPAWSQNPLYR RYLQTYLAWRKELHDWIEHSSLSEQDASRG HFVINLMTEAMAPSNSMANPAAVKRFFETG GKSLLDGMSHLAKDMINNGGMPSQVNMAA FEVGKNLATTEGAVVFRNDVLELIQYKPITE SVHERPLLVVPPQINKFYVFDLSPDKSLARFL LRSQVQTFVVSWRNPTKAQREWGLSTYIAA LKEAIEVICAITGSKDVNMLGACSGGLTTAS LLGHYAALGEQKVHALTLLVSVLDTQLDTQ VALFADEKTLEAAKRRSYQAGVLEGSDMAK VFAWMRPNDLIWNYWVNNYLLGNEPPVFDI LYWNNDTTRLPAALHGEFIEMFQTNPLTRPG ALEVCGTPIDLKQVTCDFFCVAGTTDHITPW DSCYKSAHLFGGKCEFVLSNSGHIQSILNPPG NPKARYMTNSEMPADPKAWQESSTKHADS WWLHWQSWLAERSGKTKNAPTALGNKKFP AGEAAPGTYVHER |

TABLE 14-continued

Protein Sequences of the enzymes involved in the genetic modification.
(Amino acids listed in bold and underlined represent modifications made in applicants' alleles)

| SEQ ID NO | Enzyme | FASTA Header | Protein Sequence - NCBI Database |
|---|---|---|---|
| SEQ ID NO: 297 | phaC | >gi\|151442\|gb\|AAA25932.1\| PHA-polymerase 1 [Pseudomonas oleovorans] | MSNKNNDELQRQASENTLGLNPVIGIRRKDL<br>LSSARTVLRQAVRQPLHSAKHVAHFGLELK<br>NVLLGKSSLAPESDDRRFNDPAWSNNPLYR<br>RYLQTYLAWRKELQDWIGNSDLSPQDISRG<br>QFVINLMTEAMAPTNTLSNPAAVKRFFETGG<br>KSLLDGLSNLAKDLVNNGGMPSQVNMDAF<br>EVGKNLGTSEGAVVYRNDVLELIQYKPITEQ<br>VHARPLLVVPPQINKFYVFDLSPEKSLARYC<br>LRSQQQTFIISWRNPTKAQREWGLSTYIDAL<br>KEAVDAVLAITGSKDLNMLGACSGGITCTAL<br>VGHYAALGENKVNALTLLVSVLDTTMDNQ<br>VALFVDEQTLEAAKRHSYQAGVLEGSEMAK<br>VFAWMRPNDLIWNYWVNNYLLGNEPPVFDI<br>LFWNNDTTRLPAAFHGDLIEMFKSNPLTRPD<br>ALEVCGTPIDLKQVKCDIYSLAGTNDHITPW<br>QSCYRSAHLFGGKIEFVLSNSGHIQSILNPPG<br>NPKARFMTGADRPGDPVAWQENATKHADS<br>WWLHWQSWLGERAGELEKAPTRLGNRAYA<br>AGEASPGTYVHER |
| SEQ ID NO: 298 | phaC | >gi\|9951348\|gb\|AG08441.1\|AE004919_2 poly(3-hydroxyalkanoic acid) synthase 1 [Pseudomonas aeruginosa PA01] | MSQKNNNELPKQAAENTLNLNPVIGIRGKDL<br>LTSARMVLLQAVRQPLHSARHVAHFSLELK<br>NVLLGQSELRPGDDDRRFSDPAWSQNPLYK<br>RYMQTYLAWRKELHSWISHSDLSPQDISRG<br>QFVINLLTEAMSPTNSLSNPAAVKRFFETGG<br>KSLLDGLGHLAKDLVNNGGMPSQVDMDAF<br>EVGKNLATTEGAVVFRNDVLELIQYRPITES<br>VHERPLLVVPPQINKFYVFDLSPDKSLARFCL<br>RNGVQTFIVSWRNPTKSQREWGLTTYIEALK<br>EAIEVVLSITGSKDLNLLGACSGGITTATLVG<br>HYVASGEKKVNAFTQLVSVLDFELNTQVAL<br>FADEKTLEAAKRRSYQSGVLEGKDMAKVFA<br>WMRPNDLIWNYWVNNYLLGNQPPAFDILY<br>WNNDTTRLPAALHGEFVELFKSNPLNRPGA<br>LEVSGTPIDLKQVTCDFYCVAGLNDHITPWE<br>SCYKSARLLGGKCEFILSNSGHIQSILNPPGNP<br>KARFMTNPELPAEPKAWLEQAGKHADSWW<br>LHWQQWLAERSGKTRKAPASLGNKTYPAG<br>EAAPGTYVHER |

IV. Methods and Modification Techniques Relating to Genes, Nucleotide Sequences, and Amino Acid Sequences

A. Amino Acid Sequence Variants

Some amino acids in amino acid sequences can be varied without significant effect on the structure or function of proteins. Variants included can constitute deletions, insertions, inversions, repeats, and type substitutions so long as the indicated enzyme activity is not significantly adversely affected. Guidance concerning which amino acid changes are likely to be phenotypically silent can be found, inter alia, in Bowie, J. U., et al., "Deciphering the Message in Protein Sequences: Tolerance to Amino Acid Substitutions," Science 247:1306-1310 (1990). In various embodiments polypeptides obtained by the expression of the polynucleotide molecules of the present invention may have at least approximately 50%, 60%, 70%, 80%, 90%, 95%, 96%, 97%, 98%, 99% or 100% identity to one or more amino acid sequences encoded by the genes and/or nucleic acid sequences described herein for the fatty acid or fatty acid derived product tolerance-related and biosynthesis pathways.

It will be appreciated by those skilled in the art that amino acids homologous to those described herein are within the scope of the present invention. It will be appreciated that amino acid "homology" includes conservative substitutions, i.e. those that substitute a given amino acid in a polypeptide by another amino acid of similar characteristics. Typically seen as conservative substitutions are the following replacements: replacements of an aliphatic amino acid such as Ala, Val, Leu and Ile with another aliphatic amino acid; replacement of a Ser with a Thr or vice versa; replacement of an acidic residue such as Asp or Glu with another acidic residue; replacement of a residue bearing an amide group, such as Asn or Gln, with another residue bearing an amide group; exchange of a basic residue such as Lys or Arg with another basic residue; and replacement of an aromatic residue such as Phe or Tyr with another aromatic residue.

For all nucleic acid and amino acid sequences provided herein, it is appreciated that conservatively modified variants of these sequences are included, and are within the scope of the invention in its various embodiments. Functionally equivalent nucleic acid and amino acid sequences (functional variants), which may include conservatively modified variants as well as more extensively varied sequences, which are well within the skill of the person of ordinary skill in the art, and microorganisms comprising these, also are within the scope of various embodiments of the invention, as are methods and systems comprising such sequences and/or microorganisms. In various embodiments, nucleic acid sequences encoding sufficiently homologous proteins or portions thereof are within the scope of the invention. More generally, nucleic acids sequences that encode a particular amino acid sequence employed in the invention may vary due to the degeneracy of the genetic code, and nonetheless fall within the scope of the invention. Table 15 provides a summary of similarities among amino acids, upon which conservative and less conservative substitutions may be based, and also various codon redundancies that reflect this degeneracy.

TABLE 15

Amino Acid Conservative Substitutions

| Amino Acid | Relation-ships | DNA codons |
|---|---|---|
| Alanine | N, Ali | GCT, GCC, GCA, GCG |
| Proline | N | CCT, CCC, CCA, CCG |
| Valine | N, Ali | GTT, GTC, GTA, GTG |
| Leucine | N, Ali | CTT, CTC, CTA, CTG, TTA, TTG |
| Isoleucine | N, Ali | ATT, ATC, ATA |
| Methionine | N | ATG |
| Phenylalanine | N, Aro | TTT, TTC |
| Tryptophan | N | TGG |
| Glycine | PU | GGT, GGC, GGA, GGG |
| Serine | PU | TCT, TCC, TCA, TCG, AGT, AGC |
| Threonine | PU | ACT, ACC, ACA, ACG |
| Asparagine | PU, Ami | AAT, AAC |
| Glutamine | PU, Ami | CAA, CAG |
| Cysteine | PU | TGT, TGC |
| Aspartic acid | NEG, A | GAT, GAC |
| Glutamic acid | NEG, A | GAA, GAG |
| Arginine | POS, B | CGT, CGC, CGA, CGG, AGA, AGG |
| Lysine | POS, B | AAA, AAG |
| Histidine | POS | CAT, CAC |
| Tyrosine | Aro | TAT, TAC |
| Stop Codons | | TAA, TAG, TGA |

Legend: side groups and other related properties: A=acidic; B=basic; Ali=aliphatic; Ami=amine; Aro=aromatic; N=nonpolar; PU=polar uncharged; NEG=negatively charged; POS=positively charged.

Also, variants and portions of particular nucleic acid sequences, and respective encoded amino acid sequences recited herein may be exhibit a desired functionality, e.g., enzymatic activity at a selected level, when such nucleic acid sequence variant and/or portion contains a 15 nucleotide sequence identical to any 15 nucleotide sequence set forth in the nucleic acid sequences recited herein including, without limitation, the sequence starting at nucleotide number 1 and ending at nucleotide number 15, the sequence starting at nucleotide number 2 and ending at nucleotide number 16, the sequence starting at nucleotide number 3 and ending at nucleotide number 17, and so forth. It will be appreciated that the invention also provides isolated nucleic acid that contains a nucleotide sequence that is greater than 15 nucleotides (e.g., 16, 17, 18, 19, 20, 21, 22, 23, 24, 25, 26, 27, 28, 29, 30 or more nucleotides) in length and identical to any portion of the sequence set forth in nucleic acid sequences recited herein. For example, the invention provides isolated nucleic acid that contains a 25 nucleotide sequence identical to any 25 nucleotide sequence set forth in any one or more (including any grouping of) nucleic acid sequences recited herein including, without limitation, the sequence starting at nucleotide number 1 and ending at nucleotide number 25, the sequence starting at nucleotide number 2 and ending at nucleotide number 26, the sequence starting at nucleotide number 3 and ending at nucleotide number 27, and so forth. Additional examples include, without limitation, isolated nucleic acids that contain a nucleotide sequence that is 50 or more nucleotides (e.g., 100, 150, 200, 250, 300, or more nucleotides) in length and identical to any portion of any of the sequences disclosed herein. Such isolated nucleic acids can include, without limitation, those isolated nucleic acids containing a nucleic acid sequence represented in any one section of discussion and/or examples, such as regarding a fatty acid or fatty acid derived product production pathways, nucleic acid sequences encoding enzymes of the fatty acid synthase system, or a fatty acid or fatty acid derived product tolerance. For example, the invention provides an isolated nucleic acid containing a nucleic acid sequence listed herein that contains a single insertion, a single deletion, a single substitution, multiple insertions, multiple deletions, multiple substitutions, or any combination thereof (e.g., single deletion together with multiple insertions). Such isolated nucleic acid molecules can share at least 60, 65, 70, 75, 80, 85, 90, 95, 97, 98, or 99 percent sequence identity with a nucleic acid sequence listed herein (i.e., in the sequence listing).

Additional examples include, without limitation, isolated nucleic acids that contain a nucleic acid sequence that encodes an amino acid sequence that is 50 or more amino acid residues (e.g., 100, 150, 200, 250, 300, or more amino acid residues) in length and identical to any portion of an amino acid sequence listed or otherwise disclosed herein.

In addition, the invention provides isolated nucleic acid that contains a nucleic acid sequence that encodes an amino acid sequence having a variation of an amino acid sequence listed or otherwise disclosed herein. For example, the invention provides isolated nucleic acid containing a nucleic acid sequence encoding an amino acid sequence listed or otherwise disclosed herein that contains a single insertion, a single deletion, a single substitution, multiple insertions, multiple deletions, multiple substitutions, or any combination thereof (e.g., single deletion together with multiple insertions). Such isolated nucleic acid molecules can contain a nucleic acid sequence encoding an amino acid sequence that shares at least 60, 65, 70, 75, 80, 85, 90, 95, 97, 98, or 99 percent sequence identity with an amino acid sequence listed or otherwise disclosed herein.

Examples of properties that provide the bases for conservative and other amino acid substitutions are exemplified in Table 15. Accordingly, one skilled in the art may make numerous substitutions to obtain an amino acid sequence variant that exhibits a desired functionality. BLASTP, CLUSTALP, and other alignment and comparison tools may be used to assess highly conserved regions, to which fewer substitutions may be made (unless directed to alter activity to a selected level, which may require multiple substitutions). More substitutions may be made in regions recognized or believed to not be involved with an active site or other binding or structural motif. In accordance with Table 15, for example, substitutions may be made of one polar uncharged (PU) amino acid for a polar uncharged amino acid of a listed sequence, optionally considering size/molecular weight (i.e., substituting a serine for a threonine). Guidance concerning which amino acid changes are likely to be phenotypically silent can be found, inter alia, in Bowie, J. U., et Al., "Deciphering the Message in Protein Sequences: Tolerance to Amino Acid Substitutions," Science 247:1306-1310 (1990). This reference is incorporated by reference for such teachings, which are, however, also generally known to those skilled in the art. Recognized conservative amino acid substitutions comprise (substitutable amino acids following each colon of a set): ala:ser; arg:lys; asn:gln or his; asp:glu; cys:ser; gln:asn; glu:asp; gly:pro; his:asn or gln; ile:leu or val; leu:ile or val; lys: arg or gln or glu; met:leu or ile; phe:met or leu or tyr; ser:thr; thr:ser; trp:tyr; tyr:trp or phe; val:ile or leu.

It is noted that codon preferences and codon usage tables for a particular species can be used to engineer isolated nucleic acid molecules that take advantage of the codon usage preferences of that particular species. For example, the isolated nucleic acid provided herein can be designed to have codons that are preferentially used by a particular microorganism of interest. Numerous software and sequencing services are available for such codon-optimizing of sequences.

The invention provides polypeptides that contain the entire amino acid sequence of an amino acid sequence listed or otherwise disclosed herein. In addition, the invention provides polypeptides that contain a portion of an amino acid sequence listed or otherwise disclosed herein. For example, the invention provides polypeptides that contain a 15 amino acid sequence identical to any 15 amino acid sequence of an amino acid sequence listed or otherwise disclosed herein including, without limitation, the sequence starting at amino acid residue number 1 and ending at amino acid residue number 15, the sequence starting at amino acid residue number 2 and ending at amino acid residue number 16, the sequence starting at amino acid residue number 3 and ending at amino acid residue number 17, and so forth. It will be appreciated that the invention also provides polypeptides that contain an amino acid sequence that is greater than 15 amino acid residues (e.g., 16, 17, 18, 19, 20, 21, 22, 23, 24, 25, 26, 27, 28, 29, 30 or more amino acid residues) in length and identical to any portion of an amino acid sequence listed or otherwise disclosed herein For example, the invention provides polypeptides that contain a 25 amino acid sequence identical to any 25 amino acid sequence of an amino acid sequence listed or otherwise disclosed herein including, without limitation, the sequence starting at amino acid residue number 1 and ending at amino acid residue number 25, the sequence starting at amino acid residue number 2 and ending at amino acid residue number 26, the sequence starting at amino acid residue number 3 and ending at amino acid residue number 27, and so forth. Additional examples include, without limitation, polypeptides that contain an amino acid sequence that is 50 or more amino acid residues (e.g., 100, 150, 200, 250, 300 or more amino acid residues) in length and identical to any portion of an amino acid sequence listed or otherwise disclosed herein. Further, it is appreciated that, per above, a 15 nucleotide sequence will provide a 5 amino acid sequence, so that the latter, and higher-length amino acid sequences, may be defined by the above-described nucleotide sequence lengths having identity with a sequence provided herein.

In addition, the invention provides polypeptides that an amino acid sequence having a variation of the amino acid sequence set forth in an amino acid sequence listed or otherwise disclosed herein. For example, the invention provides polypeptides containing an amino acid sequence listed or otherwise disclosed herein that contains a single insertion, a single deletion, a single substitution, multiple insertions, multiple deletions, multiple substitutions, or any combination thereof (e.g., single deletion together with multiple insertions). Such polypeptides can contain an amino acid sequence that shares at least 60, 65, 70, 75, 80, 85, 90, 95, 97, 98 or 99 percent sequence identity with an amino acid sequence listed or otherwise disclosed herein. A particular variant amino acid sequence may comprise any number of variations as well as any combination of types of variations.

As indicated herein, polypeptides having a variant amino acid sequence can retain enzymatic activity. Such polypeptides can be produced by manipulating the nucleotide sequence encoding a polypeptide using standard procedures such as site-directed mutagenesis or various PCR techniques. As noted herein, one type of modification includes the substitution of one or more amino acid residues for amino acid residues having a similar chemical and/or biochemical property. For example, a polypeptide can have an amino acid sequence set forth in an amino acid sequence listed or otherwise disclosed herein comprising one or more conservative substitutions.

More substantial changes can be obtained by selecting substitutions that are less conservative, and/or in areas of the sequence that may be more critical, for example selecting residues that differ more significantly in their effect on maintaining: (a) the structure of the polypeptide backbone in the area of the substitution, for example, as a sheet or helical conformation; (b) the charge or hydrophobicity of the polypeptide at the target site; or (c) the bulk of the side chain. The substitutions that in general are expected to produce the greatest changes in polypeptide function are those in which: (a) a hydrophilic residue, e.g., serine or threonine, is substituted for (or by) a hydrophobic residue, e.g., leucine, isoleucine, phenylalanine, valine or alanine; (b) a cysteine or proline is substituted for (or by) any other residue; (c) a residue having an electropositive side chain, e.g., lysine, arginine, or histidine, is substituted for (or by) an electronegative residue, e.g., glutamic acid or aspartic acid; or (d) a residue having a bulky side chain, e.g., phenylalanine, is substituted for (or by) one not having a side chain, e.g., glycine. The effects of these amino acid substitutions (or other deletions or additions) can be assessed for polypeptides having enzymatic activity by analyzing the ability of the polypeptide to catalyze the conversion of the same substrate as the related native polypeptide to the same product as the related native polypeptide. Accordingly, polypeptides having 5, 10, 20, 30, 40, 50 or less conservative substitutions are provided by the invention.

B. Determining Amino Acid Sequence Identity

As a practical matter, whether any particular polypeptide is at least 50%, 60%, 70%, 80%, 85%, 90%, 92%, 95%, 96%, 97%, 98% or 99% identical to any reference amino acid sequence of any polypeptide described herein (which may correspond with a particular nucleic acid sequence described herein), such particular polypeptide sequence can be determined conventionally using known computer programs such the Bestfit program (Wisconsin Sequence Analysis Package, Version 8 for Unix, Genetics Computer Group, University Research Park, 575 Science Drive, Madison, Wis. 53711). When using Bestfit or any other sequence alignment program to determine whether a particular sequence is, for instance, 95% identical to a reference sequence according to the present invention, the parameters are set such that the percentage of identity is calculated over the full length of the reference amino acid sequence and that gaps in homology of up to 5% of the total number of amino acid residues in the reference sequence are allowed.

For example, in a specific embodiment the identity between a reference sequence (query sequence, i.e., a sequence of the present invention) and a subject sequence, also referred to as a global sequence alignment, may be determined using the FASTDB computer program based on the algorithm of Brutlag et al. (Comp. App. Biosci. 6:237-245 (1990)). Preferred parameters for a particular embodiment in which identity is narrowly construed, used in a FASTDB amino acid alignment, are: Scoring Scheme=PAM (Percent Accepted Mutations) 0, k-tuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject amino acid sequence, whichever is shorter. According to this embodiment, if the subject sequence is shorter than the query sequence due to N- or C-terminal deletions, not because of internal deletions, a manual correction is made to the results to take into consideration the fact that the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are lateral to the N- and C-terminal of the subject sequence, which are not matched/aligned with a corresponding subject residue, as a percent of the total bases of the query sequence. A determination of whether a residue is matched/aligned is determined by results of the FASTDB sequence alignment. This percentage is then subtracted from the percent identity, calculated by the FASTDB program using the specified parameters, to arrive at a final percent identity score. This final percent identity score is what is used for the purposes of this embodiment. Only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence are considered for this manual correction. For example, a 90 amino acid residue subject sequence is aligned with a 100 residue query sequence to determine percent identity. The deletion occurs at the N-terminus of the subject sequence and therefore, the FASTDB alignment does not show a matching/alignment of the first 10 residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100 residue query sequence. This time the deletions are internal deletions so there are no residues at the N- or C-termini of the subject sequence which are not matched/aligned with the query. In this case the percent identity calculated by FASTDB is not manually corrected. Once again, only residue positions outside the N- and C-terminal ends of the subject sequence, as displayed in the FASTDB alignment, which are not matched/aligned with the query sequence are manually corrected for.

C. Techniques for Making Genetic Modifications and Nucleic Acid Constructs

Various methods and techniques may be used in accordance with the present invention to modify microorganisms. Embodiments of the present invention may result from introduction of an expression vector into a host microorganism, wherein the expression vector contains a nucleic acid sequence coding for an enzyme that is, or is not, normally found in a host microorganism.

The ability to genetically modify a host cell is essential for the production of any genetically modified (recombinant) microorganism. The mode of gene transfer technology may be by electroporation, conjugation, transduction, or natural transformation. A broad range of host conjugative plasmids and drug resistance markers are available. The cloning vectors are tailored to the host microorganisms based on the nature of antibiotic resistance markers that can function in that host. Also, as disclosed herein, a genetically modified (recombinant) microorganism may comprise modifications other than via plasmid introduction, including modifications to its genomic DNA.

More generally, nucleic acid constructs can be prepared comprising an isolated polynucleotide encoding a polypeptide having enzyme activity operably linked to one or more (several) control sequences that direct the expression of the coding sequence in a microorganism, such as *E. coli*, under conditions compatible with the control sequences. The isolated polynucleotide may be manipulated to provide for expression of the polypeptide. Manipulation of the polynucleotide's sequence prior to its insertion into a vector may be desirable or necessary depending on the expression vector. The techniques for modifying polynucleotide sequences utilizing recombinant DNA methods are well established in the art.

The control sequence may be an appropriate promoter sequence, a nucleotide sequence that is recognized by a host cell for expression of a polynucleotide encoding a polypeptide of the present invention. The promoter sequence contains transcriptional control sequences that mediate the expression of the polypeptide. The promoter may be any nucleotide sequence that shows transcriptional activity in the host cell of choice including mutant, truncated, and hybrid promoters, and may be obtained from genes encoding extracellular or intracellular polypeptides either homologous or heterologous to the host cell. Examples of suitable promoters for directing transcription of the nucleic acid constructs, especially in an *E. coli* host cell, are the lac promoter (Gronenborn, 1976, Mol. Gen. Genet. 148: 243-250), tac promoter (DeBoer et a/., 1983, Proceedings of the National Academy of Sciences USA 80: 21-25), trc promoter (Brosius et al, 1985, J. Biol. Chem. 260: 3539-3541), T7 RNA polymerase promoter (Studier and Moffatt, 1986, J. Mol. Biol. 189: 113-130), phage promoter $p_L$ (Elvin et al., 1990, Gene 87: 123-126), tetA promoter (Skerra, 1994, Gene 151: 131-135), araBAD promoter (Guzman et al., 1995, J. Bacteriol. 177: 4121-4130), and rhaP$_{BAD}$ promoter (Haldimann et al., 1998, J. Bacteriol. 180: 1277-1286). Other promoters are described in "Useful proteins from recombinant bacteria" in Scientific American, 1980, 242: 74-94; and in Sambrook and Russell, "Molecular Cloning: A Laboratory Manual," Third Edition 2001 (volumes 1-3), Cold Spring Harbor Laboratory Press, Cold Spring Harbor, N.Y.

The control sequence may also be a suitable transcription terminator sequence, a sequence recognized by a host cell to terminate transcription. The terminator sequence is operably linked to the 3' terminus of the nucleotide sequence encoding the polypeptide. Any terminator that is functional in an E. coli cell may be used in the present invention. It may also be desirable to add regulatory sequences that allow regulation of the expression of the polypeptide relative to the growth of the host cell. Examples of regulatory systems are those that cause the expression of the gene to be turned on or off in response to a chemical or physical stimulus, including the presence of a regulatory compound. Regulatory systems in prokaryotic systems include the lac, tac, and trp operator systems.

For various embodiments of the invention the genetic manipulations and/or modifications may be described to include various genetic manipulations, including those directed to change regulation of, and therefore ultimate activity of, an enzyme or enzymatic activity of an enzyme identified in any of the respective pathways. Such genetic modifications, and any references herein to modulating a gene, may be directed to transcriptional, translational, and post-translational modifications that result in a change of enzyme activity and/or selectivity under selected and/or identified culture conditions and/or to provision of additional nucleic acid sequences such as to increase copy number and/or mutants of an enzyme related to fatty acid or fatty acid derived product production. Specific methodologies and approaches to achieve such genetic modification and/or modulation are well known to one skilled in the art, and include, but are not limited to: increasing expression of an endogenous genetic element; decreasing functionality of a repressor gene; introducing a heterologous genetic element; increasing copy number of a nucleic acid sequence encoding a polypeptide catalyzing an enzymatic conversion step to produce fatty acid or a fatty acid derived product; mutating a genetic element to provide a mutated protein to increase specific enzymatic activity; over-expressing; under-expressing; over-expressing a chaperone; knocking out a protease; altering or modifying feedback inhibition; providing an enzyme variant comprising one or more of an impaired binding site for a repressor and/or competitive inhibitor; knocking out a repressor gene; evolution, selection and/or other approaches to improve mRNA stability as well as use of plasmids having an effective copy number and promoters to achieve an effective level of improvement. Random mutagenesis may be practiced to provide genetic modifications that may fall into any of these or other stated approaches. The genetic modifications and/or modulation further broadly fall into additions (including insertions), deletions (such as by a mutation) and substitutions of one or more nucleic acids in a nucleic acid of interest. In various embodiments a genetic modification and/or modulation results in improved enzymatic specific activity and/or turnover number of an enzyme. Without being limited, changes may be measured by one or more of the following: $K_M$; $K_{cat}$; and $K_{avidity}$.

In various embodiments, to function more efficiently, a microorganism may comprise one or more gene deletions. For example, in E. coli, the genes encoding the lactate dehydrogenase (ldhA), phosphate acetyltransferase (pta), pyruvate oxidase (poxB), and pyruvate-formate lyase (pflB) may be disrupted, including deleted. Such gene disruptions, including deletions, are not meant to be limiting, and may be implemented in various combinations in various embodiments. Gene deletions may be accomplished by mutational gene deletion approaches, and/or starting with a mutant strain having reduced or no expression of one or more of these enzymes, and/or other methods known to those skilled in the art. Gene deletions may be effectuated by any of a number of known specific methodologies, including but not limited to the RED/ET methods using kits and other reagents sold by Gene Bridges (Gene Bridges GmbH, Dresden, Germany, <<www.genebridges.com>>).

More particularly as to the latter method, use of Red/ET recombination, is known to those of ordinary skill in the art and described in U.S. Pat. Nos. 6,355,412 and 6,509,156, issued to Stewart et al. and incorporated by reference herein for its teachings of this method. Material and kits for such method are available from Gene Bridges (Gene Bridges GmbH, Dresden, Germany, <<www.genebridges.com>>), and the method may proceed by following the manufacturer's instructions. The method involves replacement of the target gene by a selectable marker via homologous recombination performed by the recombinase from λ-phage. The host microorganism expressing λ-red recombinase is transformed with a linear DNA product coding for a selectable marker flanked by the terminal regions (generally ~50 bp, and alternatively up to about ~300 bp) homologous with the target gene. The marker could then be removed by another recombination step performed by a plasmid vector carrying the FLP-recombinase, or another recombinase, such as Cre.

Targeted deletion of parts of microbial chromosomal DNA or the addition of foreign genetic material to microbial chromosomes may be practiced to alter a host cell's metabolism so as to reduce or eliminate production of undesired metabolic products. This may be used in combination with other genetic modifications such as described herein in this general example. In this detailed description, reference has been made to multiple embodiments and to the accompanying drawings in which is shown by way of illustration specific exemplary embodiments in which the invention may be practiced. These embodiments are described in sufficient detail to enable those skilled in the art to practice the invention, and it is to be understood that modifications to the various disclosed embodiments may be made by a skilled artisan.

Polypeptides and nucleic acids encoding polypeptides can be produced by standard DNA mutagenesis techniques, for example, M13 primer mutagenesis. Details of these techniques are provided in Sambrook and Russell, 2001. Nucleic acid molecules can contain changes of a coding region to fit the codon usage bias of the particular microorganism into which the molecule is to be introduced.

Alternatively, the coding region can be altered by taking advantage of the degeneracy of the genetic code to alter the coding sequence in such a way that, while the nucleic acid sequence is substantially altered, it nevertheless encodes a polypeptide having an amino acid sequence identical or substantially similar to the native amino acid sequence. For example, alanine is encoded in the open reading frame by the nucleotide codon triplet GCT. Because of the degeneracy of the genetic code, three other nucleotide codon triplets—GCA, GCC, and GCG—also code for alanine. Thus, the nucleic acid sequence of the open reading frame can be changed at this position to any of these three codons without affecting the amino acid sequence of the encoded polypeptide or the characteristics of the polypeptide. Based upon the degeneracy of the genetic code, nucleic acid variants can be derived from a nucleic acid sequence disclosed herein using standard DNA mutagenesis techniques as described herein, or by synthesis of nucleic acid sequences. Thus, for various embodiments the invention encompasses nucleic acid molecules that encode the same polypeptide but vary in nucleic acid sequence by virtue of the degeneracy of the genetic code.

The invention also provides an isolated nucleic acid that is at least about 12 bases in length (e.g., at least about 13, 14, 15, 16, 17, 18, 19, 20, 25, 30, 40, 50, 60, 100, 250, 500, 750, 1000, 1500, 2000, 3000, 4000, 5000, 6000, 7000, 8000, 9000, 10000, 11000, 12000, 13000, 14000, 15000, 16000, 17000, 18000, 19000 or 20000 bases in length) and hybridizes, under hybridization conditions, to the sense or antisense strand of a nucleic acid having a sequence listed or otherwise disclosed herein. The hybridization conditions can be moderately or highly stringent hybridization conditions.

V. Fermentation Process

In accordance with the present invention, the microorganisms described herein are used in a fermentation process to produce a desired chemical product, such as a fatty acid or fatty acid derivative, through the bioproduction pathways described herein. Without being limiting, such a process may be exemplified by providing into a vessel, such as a culture or bioreactor vessel, the following: (1) bio-production media, (2) nutrient media, such as a minimal media as known to those skilled in the art, and (3) an inoculum of a genetically modified microorganism so as to provide a population of such microorganism, such as a bacterium, and more particularly a member of the family Enterobacteriaceae, such as $E.$ $coli$. In accordance with one aspect of the invention, the genetically modified microorganism comprises a metabolic pathway that converts malonyl-CoA to a selected chemical product. The inoculum is cultured in the vessel so that the cell density increases to a cell density suitable for reaching a production level of a fatty acid or fatty acid derived product that meets the desired overall productivity metrics. In various alternative embodiments, a population of these genetically modified microorganisms may be cultured to a first cell density in a first, preparatory vessel, and then transferred to the noted vessel so as to provide the selected cell density. Numerous multi-vessel culturing strategies are known to those skilled in the art.

A. Bio-Production Media (Carbon Sources)

Bio-production media, which is used in the present invention with recombinant microorganisms having a biosynthetic pathway for a fatty acid or fatty acid derived product, may contain suitable carbon sources or substrates for the intended metabolic pathways. Suitable substrates may include, but are not limited to, monosaccharides such as glucose and fructose, oligosaccharides such as lactose or sucrose, polysaccharides such as starch or cellulose or mixtures thereof and unpurified mixtures from renewable feedstocks such as cheese whey permeate, cornsteep liquor, sugar beet molasses, and barley malt. Additionally the carbon substrate may also be one-carbon substrates such as carbon dioxide, carbon monoxide, or methanol for which metabolic conversion into key biochemical intermediates has been demonstrated. In addition to one and two carbon substrates methylotrophicmicroorganisms are also known to utilize a number of other carbon containing compounds such as methylamine, glucosamine and a variety of amino acids for metabolic activity.

Although it is contemplated that all of the above mentioned carbon substrates and mixtures thereof are suitable in the present invention as a carbon source, common carbon substrates used as carbon sources are various monomeric and oligomeric sugars, such as for example glucose, fructose, and sucrose, as well as mixtures of any of these sugars. Other suitable substrates include xylose, arabinose, other cellulose-based C-5 sugars, high-fructose corn syrup, and various other sugars and sugar mixtures as are available commercially. Sucrose may be obtained from feedstocks such as sugar cane, sugar beets, cassava, bananas or other fruit, and sweet sorghum. Glucose and dextrose may be obtained through saccharification of starch based feedstocks including grains such as corn, wheat, rye, barley, and oats. Also, in some embodiments all or a portion of the carbon source may be glycerol. Alternatively, glycerol may be excluded as an added carbon source.

In one embodiment, the carbon source is selected from glucose, fructose, sucrose, dextrose, lactose, glycerol, and mixtures thereof. Variously and independently, the amount of these components in the carbon source may be greater than about 50%, greater than about 60%, greater than about 70%, greater than about 80%, greater than about 90%, or more, up to 100% or essentially 100% of the carbon source.

In addition, methylotrophicmicroorganisms are known to utilize a number of other carbon containing compounds such as methylamine, glucosamine and a variety of amino acids for metabolic activity. For example, methylotrophic yeast are known to utilize the carbon from methylamine to form trehalose or glycerol (Bellion et al., Microb. Growth C1 Compd. (Int. Symp.), 7th (1993), 415-32. Editor(s): Murrell, J. Collin; Kelly, Don P. Publisher: Intercept, Andover, UK). Similarly, various species of $Candida$ will metabolize alanine or oleic acid (Sulter et al., Arch. Microbiol. 153:485-489 (1990)). Hence it is contemplated that the source of carbon utilized in embodiments of the present invention may encompass a wide variety of carbon-containing substrates.

In addition, fermentable sugars may be obtained from cellulosic and lignocellulosic biomass through processes of pretreatment and saccharification, as described, for example, in U.S. Patent Publication No. 2007/0031918A1, which is herein incorporated by reference. Biomass refers to any cellulosic or lignocellulosic material and includes materials comprising cellulose, and optionally further comprising hemicellulose, lignin, starch, oligosaccharides and/or monosaccharides. Biomass may also comprise additional components, such as protein and/or lipid. Biomass may be derived from a single source, or biomass can comprise a mixture derived from more than one source; for example, biomass could comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers and animal manure. Any such biomass may be used in a bio-production method or system to provide a carbon source. Various approaches to breaking down cellulosic biomass to mixtures of more available and utilizable carbon molecules, including sugars, include: heating in the presence of concentrated or dilute acid (e.g., <1% sulfuric acid); treating with ammonia; treatment with ionic salts; enzymatic degradation; and combinations of these. These methods normally follow mechanical separation and milling, and are followed by appropriate separation processes.

In various embodiments, any of a wide range of sugars, including, but not limited to sucrose, glucose, xylose, cellulose or hemicellulose, are provided to a microorganism, such as in an industrial system comprising a reactor vessel in which a defined media (such as a minimal salts media including but not limited to M9 minimal media, potassium sulfate minimal media, yeast synthetic minimal media and many others or variations of these), an inoculum of a microorganism providing one or more of the fatty acid or fatty acid derived biosynthetic pathway alternatives, and the a carbon source may be combined. The carbon source enters the cell and is catabolized by well-known and common metabolic pathways to yield common metabolic intermediates, including phosphoenolpyruvate (PEP). (See Molecular Biology of the Cell, 3rd Ed., B. Alberts et al. Garland Publishing, New York, 1994, pp. 42-45, 66-74, incorporated by reference for the teachings of basic metabolic catabolic pathways for sugars; Principles of Biochemistry, 3rd Ed., D. L. Nelson & M. M. Cox, Worth Publishers, New York, 2000, pp 527-658, incorporated by reference for the teachings of major metabolic pathways; and Biochemistry, 4th Ed., L. Stryer, W.H. Freeman and Co., New York, 1995, pp. 463-650, also incorporated by reference for the teachings of major metabolic pathways.)

Bio-based carbon can be distinguished from petroleum-based carbon according to a variety of methods, including without limitation ASTM D6866, or various other techniques. For example, carbon-14 and carbon-12 ratios differ in bio-based carbon sources versus petroleum-based sources, where higher carbon-14 ratios are found in bio-based carbon sources. In various embodiments, the carbon source is not petroleum-based, or is not predominantly petroleum based. In various embodiments, the carbon source is greater than about 50% non-petroleum based, greater than about 60% non-petroleum based, greater than about 70% non-petroleum based, greater than about 80% non-petroleum based, greater than about 90% non-petroleum based, or more. In various embodiments, the carbon source has a carbon-14 to carbon-12 ratio of about $1.0 \times 10^{-14}$ or greater, for example, $2.0 \times 10^{-14}$ or greater, $3.0 \times 10^{-14}$ or greater, $4.0 \times 10^{-14}$ or greater, $5.0 \times 10^{-14}$ or greater, $6.0 \times 10^{-14}$ or greater, $7.0 \times 10^{-14}$ or greater, $8.0 \times 10^{-14}$ or greater, $9.0 \times 10^{-14}$ or greater, or $10.0 \times 10^{-14}$ or greater.

The carbon source of any embodiment, comprising a C6 carbon source or C3 carbon source. The carbon source of any embodiment, comprising one or more cellulosic sugars, such as glucose, sucrose, fructose, dextrose, lactose, xylose, or any combination thereof. The carbon source of any embodiment, comprising less than about 50%, 40%, 30%, 20%, 10%, or 5% by mass of glycerol.

B. The Inoculum (Microorganisms)

The fermentation bioproduction process in accordance with the present invention may utilize an inoculum comprising any of the genetically modified microorganism described hereinabove. Features as described and claimed herein may be provided in a microorganism selected from the listing herein, or another suitable microorganism, that also comprises one or more natural, introduced, or enhanced fatty acid or fatty acid derived product bio-production pathways. Thus, in some embodiments the microorganism comprises an endogenous fatty acid or fatty acid derived product production pathway (which may, in some such embodiments, be enhanced), whereas in other embodiments the microorganism does not comprise an endogenous fatty acid or fatty acid derived product production pathway.

Varieties of these genetically modified microorganisms may comprise genetic modifications and/or other system alterations as may be described in other patent applications of one or more of the present inventor(s) and/or subject to assignment to the owner of the present patent application.

The examples describe specific modifications and evaluations to certain bacterial and yeast microorganisms. The scope of the invention is not meant to be limited to such species, but to be generally applicable to a wide range of suitable microorganisms. Generally, a microorganism used for the present invention may be selected from bacteria, cyanobacteria, filamentous fungi and yeasts.

For some embodiments, microbial hosts initially selected for bio-production of a selected chemical product should also utilize sugars including glucose at a high rate. Most microbes are capable of utilizing carbohydrates. However, certain environmental microbes cannot utilize carbohydrates to high efficiency, and therefore would not be suitable hosts for such embodiments that are intended for glucose or other carbohydrates as the principal added carbon source.

As the genomes of various species become known, the present invention easily may be applied to an ever-increasing range of suitable microorganisms. Further, given the relatively low cost of genetic sequencing, the genetic sequence of a species of interest may readily be determined to make application of aspects of the present invention more readily obtainable (based on the ease of application of genetic modifications to a microorganism having a known genomic sequence).

More particularly, based on the various criteria described herein, suitable microbial hosts for the bio-production of a chemical product generally may include, but are not limited to, any gram negative microorganisms, more particularly a member of the family Enterobacteriaceae, such as *E. coli*, or *Oligotropha carboxidovorans*, or *Pseudomononas* sp.; any gram positive microorganism, for example *Bacillus subtilis*, *Lactobaccilus* sp. or *Lactococcus* sp.; a yeast, for example *Saccharomyces cerevisiae*, *Pichia pastoris* or *Pichia stipitis*; and other groups or microbial species. More particularly, suitable microbial hosts for the bio-production of a fatty acid or fatty acid derived product generally include, but are not limited to, members of the genera *Clostridium, Zymomonas, Escherichia, Salmonella, Rhodococcus, Pseudomonas, Bacillus, Lactobacillus, Enterococcus, Alcaligenes, Klebsiella, Paenibacillus, Arthrobacter, Corynebacterium, Brevibacterium, Pichia, Candida, Hansenula* and *Saccharomyces*. Hosts that may be particularly of interest include: *Oligotropha carboxidovorans* (such as strain OM5), *Escherichia coli, Alcaligenes eutrophus (Cupriavidus necator), Bacillus licheniformis, Paenibacillus macerans, Rhodococcus erythropolis, Pseudomonas putida, Lactobacillus plantarum, Enterococcus faecium, Enterococcus gallinarium, Enterococcus faecalis, Bacillus subtilis* and *Saccharomyces cerevisiae*.

More particularly, suitable microbial hosts for the bio-production of fatty acid or fatty acid derived product generally include, but are not limited to, members of the genera *Clostridium, Zymomonas, Escherichia, Salmonella, Rhodococcus, Pseudomonas, Bacillus, Lactobacillus, Enterococcus, Alcaligenes, Klebsiella, Paenibacillus, Arthrobacter, Corynebacterium, Brevibacterium, Pichia, Candida, Hansenula* and *Saccharomyces*.

Hosts that may be particularly of interest include: *Oligotropha carboxidovorans* (such as strain $OM5^T$), *Escherichia coli, Alcaligenes eutrophus (Cupriavidus necator), Bacillus licheniformis, Paenibacillus macerans, Rhodococcus erythropolis, Pseudomonas putida, Lactobacillus plantarum, Enterococcus faecium, Enterococcus gallinarium, Enterococcus faecalis, Bacillus subtilis* and *Saccharomyces cerevisiae*. Also, any of the known strains of these species may be utilized as a starting microorganism, as may any of the following species including respective strains thereof— *Cupriavidus basilensis, Cupriavidus campinensis, Cupriavidus gilardi, Cupriavidus laharsis, Cupriavidus metallidurans, Cupriavidus oxalaticus, Cupriavidus pauculus, Cupriavidus pinatubonensis, Cupriavidus respiraculi,* and *Cupriavidus taiwanensis*.

In some embodiments, the recombinant microorganism is a gram-negative bacterium. In some embodiments, the recombinant microorganism is selected from the genera *Zymomonas, Escherichia, Pseudomonas, Alcaligenes*, and *Klebsiella*. In some embodiments, the recombinant microorganism is selected from the species *Escherichia coli, Cupriavidus necator, Oligotropha carboxidovorans*, and *Pseudomonas putida*. In some embodiments, the recombinant microorganism is an *E. coli* strain.

In some embodiments, the recombinant microorganism is a gram-positive bacterium. In some embodiments, the recombinant microorganism is selected from the genera *Clostridium, Salmonella, Rhodococcus, Bacillus, Lactobacillus, Enterococcus, Paenibacillus, Arthrobacter, Corynebacterium*, and *Brevibacterium*. In some embodiments, the recombinant microorganism is selected from the species *Bacillus licheniformis, Paenibacillus macerans, Rhodococcus erythropolis, Lactobacillus plantarum, Enterococcus faecium, Enterococcus gallinarium, Enterococcus faecalis*, and *Bacillus subtilis*. In particular embodiments, the recombinant microorganism is a *B. subtilis* strain.

In some embodiments, the recombinant microorganism is yeast. In some embodiments, the recombinant microorganism is selected from the genera *Pichia, Candida, Hansenula, Klebsiella, Issatchenkia*, and *Saccharomyces*. In particular embodiments, the recombinant microorganism is *Saccharomyces cerevisiae*.

It is further appreciated, in view of the disclosure, that any of the above microorganisms may be used for production of chemical products other than fatty acid or fatty acid derived product.

The ability to genetically modify the host is essential for the production of any recombinant microorganism. The mode of gene transfer technology may be by electroporation, conjugation, transduction or natural transformation. A broad range of host conjugative plasmids and drug resistance markers are available. The cloning vectors are tailored to the host microorganisms based on the nature of antibiotic resistance markers that can function in that host.

C. Fermentation Nutrient Media and Culture Conditions

In addition to an appropriate carbon source, such as selected from one of the herein-disclosed types, bio-production media must contain suitable minerals, salts, cofactors, buffers and other components, known to those skilled in the art, suitable for the growth of the cultures and promotion of the enzymatic pathway necessary for chemical product bio-production under the present invention.

Another aspect of the invention regards media and culture conditions that comprise genetically modified microorganisms of the invention and optionally supplements.

Typically cells are grown at a temperature in the range of about 25° C. to about 40° C. in an appropriate medium, as well as up to 70° C. for thermophilic microorganisms. Suitable growth media in the present invention are common commercially prepared media such as Luria Bertani (LB) broth, Terrific Broth (TB), M9 minimal media, Sabouraud Dextrose (SD) broth, Yeast medium (YM) broth, (Ymin) yeast synthetic minimal media, and minimal media as described herein, such as M9 minimal media. Other defined or synthetic growth media may also be used, and the appropriate medium for growth of the particular microorganism will be known by one skilled in the art of microbiology or bio-production science. In various embodiments a minimal media may be developed and used that does not comprise, or that has a low level of addition of various components, for example less than 10, 5, 2 or 1 g/L of a complex nitrogen source including but not limited to yeast extract, peptone, tryptone, soy flour, corn steep liquor, or casein. These minimal medias may also have limited supplementation of vitamin mixtures including biotin, vitamin B12 and derivatives of vitamin B12, thiamin, pantothenate and other vitamins. Minimal media may also have limited simple inorganic nutrient sources containing less than 28, 17, or 2.5 mM phosphate, less than 25 or 4 mM sulfate, and less than 130 or 50 mM total nitrogen.

Suitable pH ranges for the bio-production are from pH 3.0 to pH 10.0, where pH 6.0 to pH 8.0 is a typical pH range for the initial condition. For example, the pH can be 2.0, 3.0, 4.0, 5.0, 6.0, 7.0, 8.0, 9.0, or 10.0 However, the actual culture conditions for a particular embodiment are not meant to be limited by these pH ranges.

Bio-productions may be performed under aerobic, microaerobic, or anaerobic conditions, with or without agitation.

In various embodiments, specific supplements to a bioreactor vessel comprising such microorganism population may also be provided to further improve the methods and systems.

D. Bio-Production Reactors and Systems

Fermentation systems utilizing methods and/or compositions according to the invention are also within the scope of the invention.

Any of the recombinant microorganisms as described and/or referred to herein may be introduced into an industrial bio-production system where the microorganisms convert a carbon source into a fatty acid or fatty acid derived product in a commercially viable operation. The bio-production system includes the introduction of such a recombinant microorganism into a bioreactor vessel, with a carbon source substrate and bio-production media suitable for growing the recombinant microorganism, and maintaining the bio-production system within a suitable temperature range (and dissolved oxygen concentration range if the reaction is aerobic or microaerobic) for a suitable time to obtain a desired conversion of a portion of the substrate molecules to a selected chemical product. Industrial bio-production systems and their operation are well-known to those skilled in the arts of chemical engineering and bioprocess engineering.

Bio-productions may be performed under aerobic, microaerobic, or anaerobic conditions, with or without agitation. The operation of cultures and populations of microorganisms to achieve aerobic, microaerobic and anaerobic conditions are known in the art, and dissolved oxygen levels of a liquid culture comprising a nutrient media and such microorganism populations may be monitored to maintain or confirm a desired aerobic, microaerobic or anaerobic condition. When syngas is used as a feedstock, aerobic, microaerobic, or anaerobic conditions may be utilized. When sugars are used, anaerobic, aerobic or microaerobic conditions can be implemented in various embodiments.

Any of the recombinant microorganisms as described and/or referred to herein may be introduced into an industrial bio-production system where the microorganisms convert a carbon source into a selected chemical product in a commercially viable operation. The bio-production system includes the introduction of such a recombinant microorganism into a bioreactor vessel, with a carbon source substrate and bio-production media suitable for growing the recombinant microorganism, and maintaining the bio-production system within a suitable temperature range (and dissolved oxygen concentration range if the reaction is aerobic or microaerobic) for a suitable time to obtain a desired conversion of a portion of the substrate molecules to the selected chemical product.

In various embodiments, syngas components or sugars are provided to a microorganism, such as in an industrial system comprising a reactor vessel in which a defined media (such as a minimal salts media including but not limited to M9 minimal media, potassium sulfate minimal media, yeast synthetic minimal media and many others or variations of these), an inoculum of a microorganism providing an embodiment of the biosynthetic pathway(s) taught herein, and the carbon source may be combined. The carbon source enters the cell and is catabolized by well-known and common metabolic pathways to yield common metabolic intermediates, including phosphoenolpyruvate (PEP) or acetyl-CoA. (See *Molecular Biology of the Cell,* 3$^{rd}$ Ed., B. Alberts et al. Garland Publishing, New York, 1994, pp. 42-45, 66-74, incorporated by reference for the teachings of basic metabolic catabolic pathways for sugars; *Principles of Biochemistry,* 3$^{rd}$ Ed., D. L. Nelson & M. M. Cox, Worth Publishers, New York, 2000, pp. 527-658, incorporated by reference for the teachings of major metabolic pathways; and *Biochemistry,* 4$^{th}$ Ed., L. Stryer, W.H. Freeman and Co., New York, 1995, pp. 463-650, also incorporated by reference for the teachings of major metabolic pathways.).

Further to types of industrial bio-production, various embodiments of the present invention may employ a batch type of industrial bioreactor. A classical batch bioreactor system is considered "closed" meaning that the composition of the medium is established at the beginning of a respective bio-production event and not subject to artificial alterations and additions during the time period ending substantially with the end of the bio-production event. Thus, at the beginning of the bio-production event the medium is inoculated with the desired microorganism or microorganisms, and bio-production is permitted to occur without adding anything to the system. Typically, however, a "batch" type of bio-production event is batch with respect to the addition of carbon source and attempts are often made at controlling factors such as pH and oxygen concentration. In batch systems the metabolite and biomass compositions of the system change constantly up to the time the bio-production event is stopped. Within batch cultures cells moderate through a static lag phase to a high growth log phase and finally to a stationary phase where growth rate is diminished or halted. If untreated, cells in the stationary phase will eventually die. Cells in log phase generally are responsible for the bulk of production of a desired end product or intermediate.

A variation on the standard batch system is the fed-batch system. Fed-batch bio-production processes are also suitable in the present invention and comprise a typical batch system with the exception that the nutrients, including the substrate, are added in increments as the bio-production progresses. Fed-Batch systems are useful when catabolite repression is apt to inhibit the metabolism of the cells and where it is desirable to have limited amounts of substrate in the media. Measurement of the actual nutrient concentration in Fed-Batch systems may be measured directly, such as by sample analysis at different times, or estimated on the basis of the changes of measurable factors such as pH, dissolved oxygen and the partial pressure of waste gases such as $CO_2$. Batch and fed-batch approaches are common and well known in the art and examples may be found in Thomas D. Brock in *Biotechnology: A Textbook of Industrial Microbiology,* Second Edition (1989) Sinauer Associates, Inc., Sunderland, Mass., Deshpande, Mukund V., Appl. Biochem. Biotechnol., 36:227, (1992), and *Biochemical Engineering Fundamentals,* 2$^{nd}$ Ed. J. E. Bailey and D. F. Ollis, McGraw Hill, N.Y., 1986, herein incorporated by reference for general instruction on bio-production.

Although embodiments of the present invention may be performed in batch mode, or in fed-batch mode, it is contemplated that the invention would be adaptable to continuous bio-production methods. Continuous bio-production is considered an "open" system where a defined bio-production medium is added continuously to a bioreactor and an equal amount of conditioned media is removed simultaneously for processing. Continuous bio-production generally maintains the cultures within a controlled density range where cells are primarily in log phase growth. Two types of continuous bioreactor operation include a chemostat, wherein fresh media is fed to the vessel while simultaneously removing an equal rate of the vessel contents. The limitation of this approach is that cells are lost and high cell density generally is not achievable. In fact, typically one can obtain much higher cell density with a fed-batch process. Another continuous bioreactor utilizes perfusion culture, which is similar to the chemostat approach except that the stream that is removed from the vessel is subjected to a separation technique which recycles viable cells back to the vessel. This type of continuous bioreactor operation has been shown to yield significantly higher cell densities than fed-batch and can be operated continuously. Continuous bio-production is particularly advantageous for industrial operations because it has less down time associated with draining, cleaning and preparing the equipment for the next bio-production event. Furthermore, it is typically more economical to continuously operate downstream unit operations, such as distillation, than to run them in batch mode.

Continuous bio-production allows for the modulation of one factor or any number of factors that affect cell growth or end product concentration. For example, one method will maintain a limiting nutrient such as the carbon source or nitrogen level at a fixed rate and allow all other parameters to moderate. In other systems a number of factors affecting growth can be altered continuously while the cell concentration, measured by media turbidity, is kept constant. Methods of modulating nutrients and growth factors for continuous bio-production processes as well as techniques for maximizing the rate of product formation are well known in the art of industrial microbiology and a variety of methods are detailed by Brock, supra.

It is contemplated that embodiments of the present invention may be practiced using either batch, fed-batch or continuous processes and that any known mode of bio-production would be suitable. It is contemplated that cells may be immobilized on an inert scaffold as whole cell catalysts and subjected to suitable bio-production conditions for chemical product bio-production, or be cultured in liquid media in a vessel, such as a culture vessel. Thus, embodiments used in such processes, and in bio-production systems using these processes, include a population of genetically modified microorganisms of the present invention, a culture system comprising such population in a media comprising nutrients for the population, and methods of making a selected chemical product.

Embodiments of the invention include methods of making a selected chemical product in a bio-production system, some of which methods may include obtaining a fatty acid or fatty acid derived product after such bio-production event. For example, a method of making a fatty acid or fatty acid derived product may comprise: providing to a culture vessel a media comprising suitable nutrients; providing to the culture vessel an inoculum of a genetically modified microorganism comprising genetic modifications described herein such that the microorganism produces a selected chemical product from syngas and/or a sugar molecule; and maintaining the culture vessel under suitable conditions for the genetically modified microorganism to produce a selected chemical product.

It is within the scope of the present invention to produce, and to utilize in bio-production methods and systems, including industrial bio-production systems for production of a selected chemical product, a recombinant microorganism genetically engineered to modify one or more aspects effective to increase chemical product bio-production by at least 20 percent over control microorganism lacking the one or more modifications.

In various embodiments, the invention is directed to a system for bio-production of a chemical product as described herein, said system comprising: a fermentation tank suitable for microorganism cell culture; a line for discharging contents from the fermentation tank to an extraction and/or separation vessel; and an extraction and/or separation vessel suitable for removal of the chemical product from cell culture waste. In various embodiments, the system includes one or more pre-fermentation tanks, distillation columns, centrifuge vessels, back extraction columns, mixing vessels, or combinations thereof.

The following published resources are incorporated by reference herein for their respective teachings to indicate the level of skill in these relevant arts, and as needed to support a disclosure that teaches how to make and use methods of industrial bio-production of chemical product(s) produced under the invention, from sugar sources, and also industrial systems that may be used to achieve such conversion with any of the recombinant microorganisms of the present invention (Biochemical Engineering Fundamentals, $2^{nd}$ Ed. J. E. Bailey and D. F. Ollis, McGraw Hill, N.Y., 1986, entire book for purposes indicated and Chapter 9, pages 533-657 in particular for biological reactor design; Unit Operations of Chemical Engineering, 5th Ed., W. L. McCabe et al., McGraw Hill, N.Y. 1993, entire book for purposes indicated, and particularly for process and separation technologies analyses; Equilibrium Staged Separations, P. C. Wankat, Prentice Hall, Englewood Cliffs, N.J. USA, 1988, entire book for separation technologies teachings).

F. Production Metrics

In some embodiments, the genetic modification increases microbial synthesis of a selected fatty acid or fatty acid derived chemical product above a rate or titer of a control microorganism lacking said at least one genetic modification to produce a selected chemical product. In some embodiments, the genetic modification is effective to increase enzymatic conversions to a selected chemical product by at least about 5 percent, at least about 10 percent, at least about 20 percent, at least about 30 percent, or at least about 50 percent above the enzymatic conversion of a control microorganism lacking the genetic modification. In various embodiments, bio-production of a selected chemical product may reach at least 1, at least 2, at least 5, at least 10, at least 20, at least 30, at least 40, and at least 50 g/liter titer, such as by using one of the methods disclosed herein.

As may be realized by appreciation of the advances disclosed herein as they relate to commercial fermentations of selected chemical products, embodiments of the present invention may be combined with other genetic modifications and/or method or system modulations so as to obtain a microorganism (and corresponding method) effective to produce at least 10, at least 20, at least 30, at least 40, at least 45, at least 50, at least 80, at least 100, or at least 120 grams of a chemical product (such as a fatty acid or fatty acid derivative) per liter of final (e.g., spent) fermentation broth while achieving this with specific and/or volumetric productivity rates as disclosed herein. The amount of a chemical product produced in a bio-production media generally can be determined using a number of methods known in the art, for example, high performance liquid chromatography (HPLC), gas chromatography (GC), or GC/Mass Spectroscopy (MS).

Unexpected increases in specific productivity by a population of a genetically modified microorganism may be achieved in methods and systems in which that microorganism has a microbial production pathway from malonyl-CoA to a selected chemical product as well as a reduction in the enzymatic activity of a selected enzyme of the microorganism's fatty acid synthase system (more particularly, its malonyl-ACP dependent fatty acid elongation enzymes), in addition to the increase activity of a microorganisms malonyl-CoA dependent fatty acyl-CoA production pathway.

In some embodiments a microbial chemical bio-production event (i.e., a fermentation event using a cultured population of a microorganism) proceeds using a genetically modified microorganism as described herein, wherein the specific productivity is between 0.01 and 0.60 grams of selected chemical product produced per gram of microorganism cell on a dry weight basis per hour (g chemical product/g DCW-hr). In various embodiments the specific productivity is greater than 0.01, greater than 0.05, greater than 0.10, greater than 0.15, greater than 0.20, greater than 0.25, greater than 0.30, greater than 0.35, greater than 0.40, greater than 0.45, or greater than 0.50 g chemical product/g DCW-hr. Specific productivity may be assessed over a 2, 4, 6, 8, 12 or 24 hour period in a particular microbial chemical production event. More particularly, the specific productivity for a chemical product is between 0.05 and 0.10, 0.10 and 0.15, 0.15 and 0.20, 0.20 and 0.25, 0.25 and 0.30, 0.30 and 0.35, 0.35 and 0.40, 0.40 and 0.45, or 0.45 and 0.50 g chemical product/g DCW-hr., 0.50 and 0.55, or 0.55 and 0.60 g chemical product/g DCW-hr. Various embodiments comprise culture systems demonstrating such productivity.

Also, in various embodiments of the present invention the volumetric productivity achieved may be about 0.25 g fatty acid (or other chemical product) per liter per hour (g (chemical product)/L-hr), may be greater than about 0.25 g fatty acid (or other chemical product)/L-hr, may be greater than about 0.50 g fatty acid (or other chemical product)/L-hr, may be greater than about 1.0 g fatty acid (or other chemical product)/L-hr, may be greater than about 1.50 g fatty acid (or other chemical product)/L-hr, may be greater than about 2.0 g fatty acid (or other chemical product)/L-hr, may be greater than about 2.50 g fatty acid (or other chemical product)/L-hr, may be greater than about 3.0 g fatty acid (or other chemical product)/L-hr, may be greater than about 3.50 g fatty acid (or other chemical product)/L-hr, may be greater than about 4.0 g fatty acid (or other chemical product)/L-hr, may be greater than about 4.50 g fatty acid (or other chemical product)/L-hr, may be greater than about 5.0 g fatty acid (or other chemical product)/L-hr, may be greater than about 5.50 g fatty acid (or other chemical product)/L-hr, may be greater than about 6.0 g fatty acid (or other chemical product)/L-hr, may be greater than about 6.50 g fatty acid (or other chemical product)/L-hr, may be greater than about 7.0 g fatty acid (or other chemical product)/L-hr, may be greater than about 7.50 g fatty acid (or other chemical product)/L-hr, may be greater than about 8.0 g fatty acid (or other chemical product)/L-hr, may be greater than about 8.50 g fatty acid (or other chemical product)/L-hr, may be greater than about 9.0 g fatty acid (or other chemical product)/L-hr, may be greater than about 9.50 g fatty acid (or other chemical product)/L-hr, or may be greater than about 10.0 g fatty acid (or other chemical product)/L-hr.

In some embodiments, specific productivity as measured over a 24-hour fermentation (culture) period may be greater than about 0.01, 0.05, 0.10, 0.20, 0.5, 1.0, 2.0, 3.0, 4.0, 5.0, 6.0, 7.0, 8.0, 9.0, 10.0, 11.0 or 12.0 grams of chemical product per gram DCW of microorganisms (based on the final DCW at the end of the 24-hour period).

In various aspects and embodiments of the present invention, there is a resulting substantial increase in microorganism specific productivity that advances the fermentation art and commercial economic feasibility of microbial chemical production, such as of a fatty acid (but not limited thereto).

Stated in another manner, in various embodiments the specific productivity exceeds (is at least) 0.01 g chemical product/g DCW-hr, exceeds (is at least) 0.05 g chemical product/g DCW-hr, exceeds (is at least) 0.10 g chemical product/g DCW-hr, exceeds (is at least) 0.15 g chemical product/g DCW-hr, exceeds (is at least) 0.20 g chemical product/g DCW-hr, exceeds (is at least) 0.25 g chemical product/g DCW-hr, exceeds (is at least) 0.30 g chemical product/g DCW-hr, exceeds (is at least) 0.35 g chemical product/g DCW-hr, exceeds (is at least) 0.40 g chemical product/g DCW-hr, exceeds (is at least) 0.45 g chemical product/g DCW-hr, exceeds (is at least) 0.50 g chemical product/g DCW-hr, exceeds (is at least) 0.60 g chemical product/g DCW-hr. In accordance with certain embodiments of the present invention the chemical product is a fatty acid or a fatty acid derived product.

More generally, based on various combinations of the genetic modifications described herein, optionally in combination with supplementations described herein, specific productivity values for a fatty acid or fatty acid derived product, and for other chemical products described herein, may exceed 0.01 g chemical product/g DCW-hr, may exceed 0.05 g chemical product/g DCW-hr, may exceed 0.10 g chemical product/g DCW-hr, may exceed 0.15 g chemical product/g DCW-hr, may exceed 0.20 g chemical product/g DCW-hr, may exceed 0.25 g chemical product/g DCW-hr, may exceed 0.30 g chemical product/g DCW-hr, may exceed 0.35 g chemical product/g DCW-hr, may exceed 0.40 g chemical product/g DCW-hr, may exceed 0.45 g chemical product/g DCW-hr, and may exceed 0.50 g or 0.60 chemical product/g DCW-hr. Such specific productivity may be assessed over a 2, 4, 6, 8, 12 or 24 hour period in a particular microbial chemical production event.

The improvements achieved by embodiments of the present invention may be determined by percentage increase in specific productivity, or by percentage increase in volumetric productivity, compared with an appropriate control microorganism lacking the particular genetic modification combinations taught herein (with or without the supplements taught herein, added to a vessel comprising the microorganism population). For particular embodiments and groups thereof, such specific productivity and/or volumetric productivity improvements is/are at least 10, at least 20, at least 30, at least 40, at least 50, at least 100, at least 200, at least 300, at least 400, and at least 500 percent over the respective specific productivity and/or volumetric productivity of such appropriate control microorganism.

The specific methods and teachings of the specification, and/or cited references that are incorporated by reference, may be incorporated into the examples. Also, production of a chemical product may reach at least 1, at least 2, at least 5, at least 10, at least 20, at least 30, at least 40, and at least 50 g/liter titer in various embodiments.

The metrics may be applicable to any of the compositions, e.g., genetically modified microorganisms, methods, e.g., of producing chemical products, and systems, e.g., fermentation systems utilizing the genetically modified microorganisms and/or methods disclosed herein.

It is appreciated that iterative improvements using the strategies and methods provided herein, and based on the discoveries of the interrelationships of the pathways and pathway portions, may lead to even greater chemical product bio-production at the conclusion of a bio-production event.

VI. Products Produced—The Chemical Product

The novel bioproduction pathways, fermentation processes and genetically modified microorganisms described herein are engineered to produce various chemical products of interest. One chemical product may be a fatty acid of any chain length from 4 to greater than 18 carbons, for example, 5, 6, 7, 8, 9, 10, 11, 12, 13, 14, 15, 16, 17, 18, 19, 20 carbon atoms, or more carbon atoms. This group of chemical products includes: butyrate or butyric acid, valerate or valeric acid, caproate or caproic acid, enanthate or enanthic acid, caprylate or caprylic acid, pelargonate or pelargonic acid, caprate or capric acid, undecylate or undecylic acid, laurate or lauric acid, tridecylate or tridecylic acid, myristate or myristic acid, pentadecylate or pentadecylic acid, palmitate or palmitic acid, margarate or margaric acid, stearate or stearic acid, nonadecylate or nonadecylic acid, arachidate or arachidic acid. These fatty acid products may be produced from a fatty acyl-CoA intermediate via the activity of a fatty acyl-CoA thioesterase or wax ester synthase. Alternatively, these fatty acids may be produced from a fatty acyl-CoA intermediate via concerted activities of a fatty acyl-CoA phosphotransferase first producing a fatty acyl-phosphate and then the action of a fatty acid kinase operating to produce a fatty acid from the fatty acyl-phosphate.

Another chemical product may be a fatty aldehyde of any chain length from 4 to greater than 18 carbons, for example, 5, 6, 7, 8, 9, 10, 11, 12, 13, 14, 15, 16, 17, 18, 19, 20 carbon atoms, or more carbon atoms. This group of chemical products includes: Butyraldehyde, Valeraldehyde, Caproaldehyde, Enanthaldehyde, Caprylaldehyde, Pelargonaldehyde, Capraldehyde, Undecylaldehyde, Lauraldehyde, Tridecylaldehyde, Myristaldehyde, Pentadecylaldehyde, Palmitaldehyde, Margaraldehyde, Stearaldehyde, Nonadecylaldehyde, and Arachidaldehyde. These aldehyde products may be produced from a fatty acyl-CoA intermediate via the activity of a fatty acyl-CoA reductase or acyl-CoA reductase. Production strains making fatty acids may also be used to produce fatty aldehydes.

Another chemical product may be a fatty alcohol of any chain length from 4 to greater than 18 carbons, for example, 5, 6, 7, 8, 9, 10, 11, 12, 13, 14, 15, 16, 17, 18, 19, 20 carbon atoms, or more carbon atoms. This group of chemical products includes: butanol, amyl alcohol, hexanol, heptanol, octanol, nonanol, decanol, hendecanol, dodecanol, tridecanol, tetradecanol, pentadecanol, hexadecanol, heptadecanol, octadecanol, nonadecanol, and eicosanol. These fatty acid products may be produced from a fatty aldehyde via the activity of an aldehyde reductase. Production strains making fatty acids may also be used to produce fatty alcohols by expressing genes encoding enzymes that convert fatty acyl-CoA or free fatty acids to fatty alcohols. Examples of these enzymes include an alcohol-forming acyl-CoA reductase (EC 1.2.1.-), or a long-chain-fatty-acyl-CoA reductase (EC 1.2.1.50) plus an alcohol dehydrogenase (EC 1.1.1.1), or a combination of an aldehyde dehydrogenase (EC 1.2.1.-) and an alcohol dehydrogenase. A polypeptide with fatty acyl-CoA reductase activity is provided by the fabG gene of *Acinetobacter* SP. ADP1, accession number YP_047869. A polypeptide with fatty-acyl reductase activity is provided by the FAR-N_SDR_e gene of *Bombyx mori*, accession number BAC79425. A polypeptide with aldehyde dehydrogenase is provided by the ALDH gene of *Geobacillus thermodenitrificans* NG80-2, accession number YP_001125970. A polypeptide with alcohol dehydrogenase activity is provided by the yqhD gene of *E. coli*, accession number AP_003562.1. Additional sources of these activities are known to the art and can be combined to generate a production strain that produces fatty alcohols.

Another chemical product may be an alpha olefin of any chain length from 4 to greater than 18 carbons, for example, 5, 6, 7, 8, 9, 10, 11, 12, 13, 14, 15, 16, 17, 18, 19, 20 carbon atoms, or more carbon atoms.

Another chemical product may be an alkane of any chain length from 4 to greater than 18 carbons, for example, 5, 6, 7, 8, 9, 10, 11, 12, 13, 14, 15, 16, 17, 18, 19, 20 carbon atoms, or more carbon atoms.

Another chemical product may be a diacid of any chain length from 4 to greater than 18 carbons, for example, 5, 6, 7, 8, 9, 10, 11, 12, 13, 14, 15, 16, 17, 18, 19, 20 carbon atoms, or more carbon atoms. These fatty acid derived products may be produced from a fatty acid via omega or terminal oxidation by enzymes known in the art.

Any of these may be described herein as a selected chemical product, or a chemical product of interest or as a fatty acid product or as a fatty acid derivative or fatty acid product derivative. Also, any grouping, including any sub-group, of the above listing may be considered what is referred to by "selected chemical product," "chemical product of interest," and the like. For any of these chemical products a microorganism may inherently comprise a biosynthesis pathway to such chemical product and/or may require addition of one or more heterologous nucleic acid sequences to provide or complete such a biosynthesis pathway, in order to achieve a desired production of such chemical product.

VII. Disclosed Embodiments are Non-Limiting

While various embodiments of the present invention have been shown and described herein, it is emphasized that such embodiments are provided by way of example only. Numerous variations, changes and substitutions may be made without departing from the invention herein in its various embodiments. Specifically, and for whatever reason, for any grouping of compounds, nucleic acid sequences, polypeptides including specific proteins including functional enzymes, metabolic pathway enzymes or intermediates, elements, or other compositions, or concentrations stated or otherwise presented herein in a list, table, or other grouping (such as metabolic pathway enzymes shown in a scheme), unless clearly stated otherwise, it is intended that each such grouping provides the basis for and serves to identify various subset embodiments, the subset embodiments in their broadest scope comprising every subset of such grouping by exclusion of one or more members (or subsets) of the respective stated grouping. Moreover, when any range is described herein, unless clearly stated otherwise, that range includes all values therein and all sub-ranges therein.

Also, and more generally, in accordance with disclosures, discussions, examples and embodiments herein, there may be employed conventional molecular biology, cellular biology, microbiology, and recombinant DNA techniques within the skill of the art. Such techniques are explained fully in the literature. (See, e.g., Sambrook and Russell, "Molecular Cloning: A Laboratory Manual," Third Edition 2001 (volumes 1-3), Cold Spring Harbor Laboratory Press, Cold Spring Harbor, N.Y.; Animal Cell Culture, R. I. Freshney, ed., 1986.) These published resources are incorporated by reference herein for their respective teachings of standard laboratory methods found therein. Such incorporation, at a minimum, is for the specific teaching and/or other purpose that may be noted when citing the reference herein. If a specific teaching and/or other purpose is not so noted, then the published resource is specifically incorporated for the teaching(s) indicated by one or more of the title, abstract, and/or summary of the reference. If no such specifically identified teaching and/or other purpose may be so relevant, then the published resource is incorporated in order to more fully describe the state of the art to which the present invention pertains, and/or to provide such teachings as are generally known to those skilled in the art, as may be applicable. However, it is specifically stated that a citation of a published resource herein shall not be construed as an admission that such is prior art to the present invention. Also, in the event that one or more of the incorporated published resources differs from or contradicts this application, including but not limited to defined terms, term usage, described techniques, or the like, this application controls. Subject matter in the Examples is incorporated into this section to the extent not already present.

EXAMPLES

Example 1—NphT7 Mutants

The enzyme NphT7 is a 3-keto-acyl-CoA synthase that is active with acetyl-CoA as the primer and malonyl-CoA as the extender donor to generate a 3-keto-C4-CoA product; the native enzyme has no detectable activity on longer chain primers. Residue modifications were made to NphT7 to alter the acyl-CoA binding pocket to accept substrates with chain lengths greater than or equal to 4 carbons. These modifications are single amino acid changes, combinations of single amino acid changes, and targeted structural loop modifications that allow the condensation reaction of acyl-CoAs with chain lengths greater than or equal to 4 carbons, such as C4-CoA and C6-CoA, with malonyl-CoA. The modifications were made based on the following criteria:

(a) Examination of the crystal structure of a related enzyme, the fabH from *Mycobacterium tuberculosis* (structure 1U6S in the Protein DataBase) identified the residues in Table 16 that contact the acyl chain. The corresponding residues in NphT7 were identified based on homology.

TABLE 16

Residues of mtFabH that contact the acyl chain in the substrates. 1U6S (mtFabH)

| |
|---|
| Asn B81 |
| Thr B82 |
| Leu B142 |
| Thr B145 |
| Phe B157 |
| Ile B189 |
| Ser B276 |
| Val B205 |
| Gln A86 |
| Thr A87 |
| Ile A196 |
| Tyr 304 |

(b) Lid swap mutants. Comparison of the sequence and structural homologies between the mtFabH and NphT7 reveals a predicted L9 loop in NphT7 comprising residues 167-201. The amino acid sequence: GGLTD-LIRVPAGGSRQPLDTDGLDAGLQYFAMD, makes up the L9 loops structure corresponding to the acyl-CoA lid. Saturated mutagenesis of the lid (Conversion of each amino acid in the lid to every other amino acid, and combinations of mutations within the lid) may change the lid structure to accept larger acyl-CoA chains.

Mutant nphT7 genes were constructed by oligonucleotide-directed mutagenesis and all mutants were verified to be correct by DNA sequencing. Parent and mutant nphT7 genes were cloned in pET28b vectors in frame with 6 His residues, transformed into E. coli BL21(DE3), and cultures in Terrific Broth containing 35 μg/ml kanamycin were incubated at 37° C. until the $OD_{600}$ was 0.4. Expression was induced by the addition of 0.1 mM IPTG. Cells were incubated at 18° C. and harvested after 18 hours by centrifugation at 4,000 rpm at 4° C. for 10 minutes. Pellets were stored at −80° C. prior to lysis. Lysates were prepared by resuspending cells in 50 mL Lysis Buffer (25 mM Tris, pH 8.0, 300 mM NaCl, 5 mM β-mercaptoethanol, and benzonase nuclease) and lysing with a Microfluidizer (two passes). Soluble fractions were isolated by centrifugation at 12,000 RPM at 4° C. for 30 minutes. Expression was analyzed by SDS-PAGE (coomassie staining) and anti-His western blotting (4 μg soluble/lane, maintained same volume for soluble/insoluble fraction). NphT7 enzymes were purified by Ni-NTA chromatography. Loop mutants mtloop1 and mtloop2 were additionally purified using DEAE-Sepharose chromatography.

3-ketoacyl-CoA synthase activity was monitored by measuring the release of free CoA-SH using the 5,5'-dithiobis-(2-nitrobenzoic acid) (DTNB) reagent, malonyl-CoA as the donor substrate, and various primer substrates (acetyl-CoA, C4-CoA, C6-CoA, or C10-CoA). The increase in absorbance at 412 nm at 37° C. (TNB product formation; =14.14 $mM^{-1}$ $cm^{-1}$ in phosphate buffer at pH 8.0) was used to determine the enzymatic activity. 3-ketoacyl-CoA synthase activity was also monitored by coupling the production of 3-ketoacyl-CoA to the subsequent formation of the 3-hydroxyacyl-CoA product by purified PaFabG and NADPH. Reactions were carried out at room temperature for 30 min, stopped by the addition of acetonitrile to 20% and incubating on ice for 15 minutes, and analyzed by UPLC-MS/MS.

Figure 15:
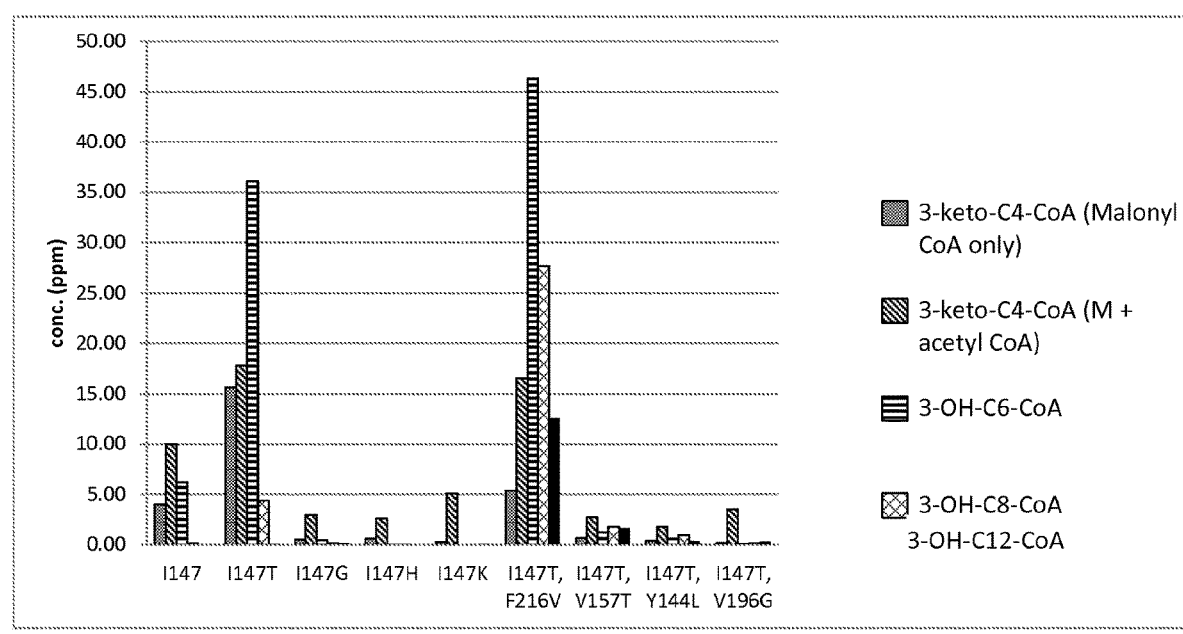
FIG. 15 is a bar chart showing the formation of acyl-CoA products produced with NphT7 variants and NphT7 mutants acting (100 μg, 30 min. assays) on Malonyl-CoA and C4-, C6-, or C10-CoA to generate the corresponding C6-, C8- and C12-hydroxyacyl-CoA in the presence of PaFabG hydroxyacyl-CoA reductase.

Specific activities of various engineered NphT7 mutants are shown in Table 17. In addition, by measuring the products of the reactions using UPLC-mass spectrometry, it was demonstrated that the variant of NphT7 with the I147T, F217V mutations produces 3-keto-C6-CoA from C4-CoA, 3-keto-C8-CoA from C6-CoA, and 3-keto-C12-CoA from C10-CoA using malonyl-CoA as the extender donor (see FIG. 15; products of the NphT7 reaction were converted to the 3-OH-acyl-CoA by PaFabG to allow quantitation by UPLC-MS). As may be seen from these results, modification of selected residues of NphT7 alters the substrate preference from the almost exclusive preference for acetyl-CoA in the wildtype enzyme to variants that have significant activity on C4-CoA, for example variants I147F, F217V and I147S, F217V.

TABLE 17

Specific Activities for various NphT7 Mutants

| | S.A. (μmol/min./mg), purified | | | |
|---|---|---|---|---|
| Mutation(s) | Acetyl-CoA | C4-CoA | C6-CoA | C10-CoA |
| N/A (wild-type) gi|299758082 | 5.52 | 0.003 | 0 | ND |
| F217V | 0.544 | 0.722 | 0.03 | 0.003 |
| I147T | 2.05 | 0.015 | 0.010 | ND |
| I147T, F217V | 0.251 | 0.47 | 0.025 | 0.003 |
| I147F, F217V | 0.461 | 1.39 | 0.054 | 0.02 |
| I147M, F217V | 0.41 | 1.103 | 0.049 | 0.013 |
| I147S, F217V | 0.855 | 1.87 | 0.075 | 0.009 |
| Y144L, I147T, F216V | 0.005 | 0.065 | 0.059 | 0.007 |

"ND" = Not Determined

Example 2—Strategies for Identifying 3-Ketoacyl-CoA Synthase Candidates

NphT7 is an ideal place to begin forming a strategy for identifying other 3-ketoacyl-CoA synthase candidates because unlike type II FAS 3-ketoacyl-ACP synthases (KAS) that uses malonyl-ACP as an extender, it can perform the targeted reaction using malonyl-CoA and therefore, homologs of NphT7 would likely have maintained specificity for malonyl-CoA. In addition, KAS III from various organisms have been characterized by crystal structures and biochemical assays to define substrate binding sites and substrate specificities. Unlike NphT7, KAS III from various organisms have shown different specificity for longer or branched acyl-CoA. There is similar information available for KAS I and KAS II but unlike KAS III that utilizes acyl-CoA as a substrate for the condensation reaction, they require acyl-ACP as a substrate. Therefore, crystal structures of known KAS III along with biochemical data provide guidance in identifying conserved residues that recognize acyl-CoA and aid in identification of NphT7 homologs that utilize longer chain acyl-CoAs.

TABLE 18

Summary of substrate specificity of KAS III from different organisms

| KAS III (FabH homologs) | Substrate Specificity[a] | Reference |
|---|---|---|
| E. coli FabH | C2-C3 | Choi et al., J Bact. 2000 |
| B. subtilis FabH1 | C2-C8* | Choi et al., J Bact. 2000 |
| B. subtilis FabH2 | C2-C7* | Choi et al., J Bact. 2000 |
| S. aureus FabH | C2-C16* | Qui et al., Protein Science 2005 |
| S. pneumoniae FabH | C2-C4 | Khandekar et. al., J. Bio. Chem. 2001 |
| M. tuberculosis FabH | C8-C16 | Choi et al., J Bio. Chem. 2000 |

[a]Substrate specificity determined by enzyme activity
*Substrates include branched chain acyl-CoA Okamura et al. (PNAS, 2010) defines the biochemical function of NphT7 and compares the amino acid sequence to other NphT7 homologs and *E. coli* KAS III, FabH (ecFabH). Mainly, the well characterized ecFabH is used to describe the similarities between all NphT7 (NphT7 and 6 NphT7 homologs) and the main differences to KAS III. The information provided by Okaramura et al. with addition of other reports describing other KAS III will be used to define rules for identifying potential 3-ketoacyl-CoA candidates.

The following five strategies for identifying 3-ketoacyl-CoA candidates were used:

1. BLASTp to identify NphT7 homologs
    Rationale:
    a. Most likely to utilize malonyl-CoA as an extender for the condensation reaction
2. Identify homologs that contains (A/G)GGSR sequence motif
    Rationale:
    a. The predicted L9 loops in the NphT7 homologs are inserted with additional sequence and share an (A/G)GGSR sequence motif
    b. Okamura et al. suggest (A/G)GGSR motif may serve as one of recognition sites for the CoA moiety of the extender substrate malonyl-CoA
    c. (A/G)GGSR motif and additional sequence are not found in KAS III homologs, thus indicating the sequence motif is specific to NphT7 homologs
    d. Reference
        i. Okamura et al., PNAS 2010
3. Select for NphT7 homologs that do not contain STPDXPQ sequence motif
    Rationale:
    a. Phe87 residue that dictates primer substrate specificity in ecFabH (KAS III) is replaced by Gln in the NphT7 homologs.
    b. All NphT7 homologs share a STPDXPQ sequence motif with Gln being part of the sequence motif.
    c. KAS III homologs do not have conserved STPDXPQ motif.
    d. Reference
        i. Okamura et al., PNAS 2010
4. Identify homologs that contain only hydrophobic residues in the substrate binding site
    Rationale:
    a. Phe87, Leu142, Phe157, Leu188, and Leu205 of ecFabH that form the hydrophobic pocket for recognition of the acetyl methyl group of acetyl-CoA are not conserved in NphT7 homologs
        i. NphT7 has 3 out 5 amino acids that are hydrophobic residues
    b. Most hydrophobic residues are conserved among KAS III homologs.
    c. Reference
        i. Okamura et al., PNAS 2010
        ii. Qui et al., Protein Science 2005
        iii. Scarsdale et al., JBC 2001
        iv. Qui et al., JBC 1999
5. Identify different families of NphT7 homologs
    Rationale:
    a. Phylogenetic tree created from multiple sequence alignment (MSA) of NphT7 homologs that have met the above requirements will be used to select candidates that would represent the most diverse group of NphT7 homologs that have evolved from different ancestors.
        i. The diversity would allow for the highest possibility of finding an NphT7 homolog with different specificity due to evolving from different ancestors Result/Outcome The following summarizes the results from the five strategies for identifying 3-ketoacyl-CoA candidates outlined above:

1. Homology search of NphT7
    a. BLAST search was performed with NphT7 as a reference sequence with maximum sequence target at 10,000 without a cutoff for e-value
        i. BLAST search resulted in 7141 homologs of NphT7
2. Select for NphT7 homologs with (A/G)GGSR motif
    a. 309 NphT7 homologs had (A/G)GGSR motif.
3. Elimination of homologs with STPDXPQ sequence motif
    a. 288 NphT7 homologs did not have STPDXPQ motif
4. Selection based on conservation of hydrophobic residues in the substrate binding pocket
    a. Of the 288 homologs, 144 NphT7 homologs had hydrophobic residues at the 5 residues that are conserved between KAS III
5. Selection based on evolutionary distance from NphT7 and known KAS III
    a. Phylogenetic tree constructed from MSA of NphT7 homologs, NphT7, ecFabH, mtFabH, bsFabH1, bsFabH2, saFabH, spFabH with (A/G)GGSR sequence motif indicate there are 6 different families of NphT7 homologs (Table 17).
    b. 22 3-ketoacyl-CoA synthase candidate were chosen to cover all 6 families
        i. 10 3-ketoacyl-CoA synthase candidates
            1. With (A/G)GGSR sequence motif
            2. Without STPDXPQ sequence motif
            3. With conserved hydrophobic residues
        ii. 11 3-ketoacyl-CoA synthase candidates
            1. With (A/G)GGSR sequence motif
            2. Without STPDXPQ sequence motif
        iii. 1 3-ketoacyl-CoA synthase candidates
            1. With (A/G)GGSR sequence motif List of 3-Ketoacyl-CoA Synthase Candidates

[00236] lists the 3-ketoacyl-CoA synthase chosen based on the criteria described above. In addition, each synthase was aligned to NphT7, ecFabH, mtFabH, and saFabH to determine percent sequence identity, similarity and gap. Synthases 1-10 are chosen based on having all criteria met. Synthases 11-21 are chosen based on having all criteria met except for conserved hydrophobic residues. Synthase 22 is chosen based on having (A/G)GGSR sequence motif

TABLE 19

List of 3-ketoacyl-CoA synthases

| | | NphT7 | | | ecFabH | | | saFabH | | | mtFabH | | |
|---|---|---|---|---|---|---|---|---|---|---|---|---|---|
| Organism | Protein ID | % Identity | % positive | % Gap | % Identity | % positive | % Gap | % Identity | % positive | % Gap | % Identity | % positive | % Gap |
| 1 *Rhodothermus marinus* SG0.5JP17-172 | YP_004823890.1 (SEQ ID NO 198) | 39 | 56 | 1 | 37 | 54 | 3 | 35 | 55 | 5 | 36 | 50 | 5 |
| 2 *Streptomyces davawensis* JCM 4913 | YP_007523119.1 (SEQ ID NO 199) | 38 | 51 | 0 | 42 | 55 | 3 | 38 | 56 | 5 | 38 | 52 | 2 |
| 3 *Chlamydophila pecorum* E58 | YP_004377485.1 (SEQ ID NO 200) | 36 | 55 | 1 | 46 | 63 | 3 | 40 | 59 | 4 | 33 | 53 | 3 |
| 4 *Clostridium ultunense* Esp | ZP_23165498.1 (SEQ ID NO 201) | 36 | 54 | 1 | 43 | 60 | 2 | 44 | 64 | 4 | 34 | 53 | 7 |
| 5 *Corallococcus coralloides* DSM 2259 | YP_005368607.1 (SEQ ID NO 202) | 42 | 57 | 2 | 49 | 63 | 5 | 34 | 54 | 6 | 41 | 62 | 6 |
| 6 *Desmospora* sp. 8437 | ZP_08463153.1 (SEQ ID NO 203) | 43 | 60 | 1 | 50 | 67 | 2 | 38 | 57 | 1 | 52 | 72 | 4 |
| 7 *Paenibacillus peoriae* KCTC 3763 | ZP_10239638.1 (SEQ ID NO 204) | 44 | 58 | 1 | 47 | 65 | 2 | 38 | 55 | 1 | 55 | 73 | 4 |
| 8 *Pelosinus fermentans* DSM 17108 | ZP_10324886.1 (SEQ ID NO 205) | 41 | 62 | 2 | 46 | 64 | 2 | 38 | 57 | 3 | 48 | 69 | 4 |
| 9 *Candidatus Solibacter usitatus* Ellin6076 | YP_828246.1 (SEQ ID NO 206) | 35 | 53 | 2 | 42 | 60 | 3 | 37 | 58 | 5 | 35 | 52 | 10 |
| 10 *Desulfotomaculum nigrificans* DSM 574 | ZP_08114352.1 (SEQ ID NO 207) | 40 | 59 | 1 | 46 | 66 | 2 | 47 | 69 | 4 | 37 | 55 | 6 |
| 11 *Saccharomonospora glauca* K62 | ZP_10013188.1 (SEQ ID NO 208) | 40 | 55 | 2 | 32 | 51 | 5 | 35 | 54 | 5 | 30 | 48 | 5 |
| 12 *Corallococcus coralloides* | ADI59524.1 (SEQ ID NO 209) | 29 | 47 | 2 | 33 | 48 | 7 | 27 | 47 | 6 | 25 | 41 | 8 |
| 13 *Legionella pneumophila* str. Corby | YP_001250982.1 (SEQ ID NO 210) | 32 | 45 | 6 | 32 | 50 | 5 | 31 | 53 | 6 | 27 | 45 | 3 |
| 14 *Streptomyces avermitilis* | BAB69376.1 (SEQ ID NO 211) | 42 | 54 | 2 | 40 | 55 | 3 | 36 | 54 | 5 | 38 | 51 | 2 |
| 15 *Verrucosispora maris* AB-18-032 | YP_004406674.1 (SEQ ID NO 212) | 41 | 52 | 5 | 36 | 55 | 3 | 36 | 56 | 5 | 36 | 50 | 11 |
| 16 *Rhodopirellula baltica* SH 1 | CAD74700.1 (SEQ ID NO 213) | 42 | 57 | 6 | 42 | 56 | 8 | 40 | 60 | 9 | 32 | 47 | 9 |
| 17 *Candidatus Methylomirabilis oxyfera* | YP_003206328.1 (SEQ ID NO 214) | 43 | 58 | 2 | 48 | 66 | 3 | 44 | 65 | 4 | 39 | 54 | 3 |
| 18 *Thermaerobacter marianensis* DSM 12885 | YP_004101787.1 (SEQ ID NO 215) | 43 | 59 | 1 | 47 | 62 | 2 | 46 | 65 | 4 | 41 | 56 | 3 |
| 19 *Caldisericum exile* AZM16c01 | YP_005472409.1 (SEQ ID NO 216) | 38 | 59 | 1 | 49 | 64 | 2 | 47 | 69 | 4 | 37 | 57 | 4 |
| 20 *Indibacter alkaliphilus* LW1 | ZP_11015628.1 (SEQ ID NO 217) | 30 | 51 | 2 | 40 | 59 | 3 | 39 | 59 | 6 | 33 | 50 | 4 |
| 21 *Candidatus Amoebophilus asiaticus* 5a2 | YP_001957829.1 (SEQ ID NO 218) | 34 | 52 | 3 | 36 | 57 | 4 | 37 | 57 | 5 | 32 | 50 | 3 |
| 22 *Flavobacterium* sp. F52 | ZP_10480443.1 (SEQ ID NO 219) | 34 | 52 | 2 | 38 | 56 | 3 | 38 | 57 | 4 | 31 | 53 | 5 |

Example 3—Combining NphT7 Variants and/or fabH Homologs and Thioesterases to Produce Fatty Acids with Specified Chain Lengths While mutants of NphT7 were engineered that are capable of extending acyl-CoAs of chain length C4, C6, and C10, the specific activities of these enzymes are relatively low for the higher chain lengths. The extension by 2 carbon lengths of acyl-CoAs to form 3-keto-acyl-CoAs is a reaction also carried out by keto-acyl-CoA synthases known as KASIII enzymes, encoded by fabH gene homologs. A number of such gene homologs were synthesized using codons for optimal expression in *E. coli* by a commercial DNA synthesis provider (DNA2.0) and fused with 6 His residues at the N-terminus for purification of the proteins by affinity chromatography. The genes were expressed in *E. coli* and KAS activity was assayed using the DTNB assay for CoA-SH release from the condensation of malonyl-CoA with acyl-CoAs of varying chain lengths. Table 20 lists the enzyme homologs with sufficiently high level KAS activity to enable such enzymes to extend the acyl-CoAs of the various chain lengths noted in the table. As may be seen from the results in Table 20, FabH enzymes from different sources have different substrate chain-length preferences.

TABLE 20

High level KAS activity

| Enzymes | Organisms |
|---|---|
| Acetyl-CoA | Streptomyces sp. (strain CL190) |
|  | Pelosinus fermentans DSM 17108 |
|  | Saccharomonospora glauca K62 |
|  | Verrucosispora maris AB-18-032 |
|  | Clostridiales bacterium 1_7_47_FAA |
| C4-CoA | Streptomyces sp. (strain CL190) |
|  | Saccharomonospora glauca K62 |
|  | Saccharomonospora azurea NA-128 |
|  | Mesorhizobium sp. STM 4661 |
|  | Clostridiales bacterium 1_7_47_FAA |
| C6-CoA | Gordonia aichiensis NBRC 108223 |
|  | Arcobacter butzleri ED-1 |
|  | Clostridiales bacterium 1_7_47_FAA |
|  | Saccharomonospora glauca K62 |
|  | Ralstonia solanacearum Po82 |
| C8-CoA | Gordonia aichiensis NBRC 108223 |
|  | Gluconacetobacter oboediens 174Bp2 |
|  | Arcobacter butzleri ED-1 |
|  | Ralstonia solanacearum Po82 |
|  | Phaeobacter gallaeciensis 2.10 |
| C10-CoA | Alishewanella aestuarii B11 |
|  | Streptomyces sp. (strain CL190) |

Figure 16:
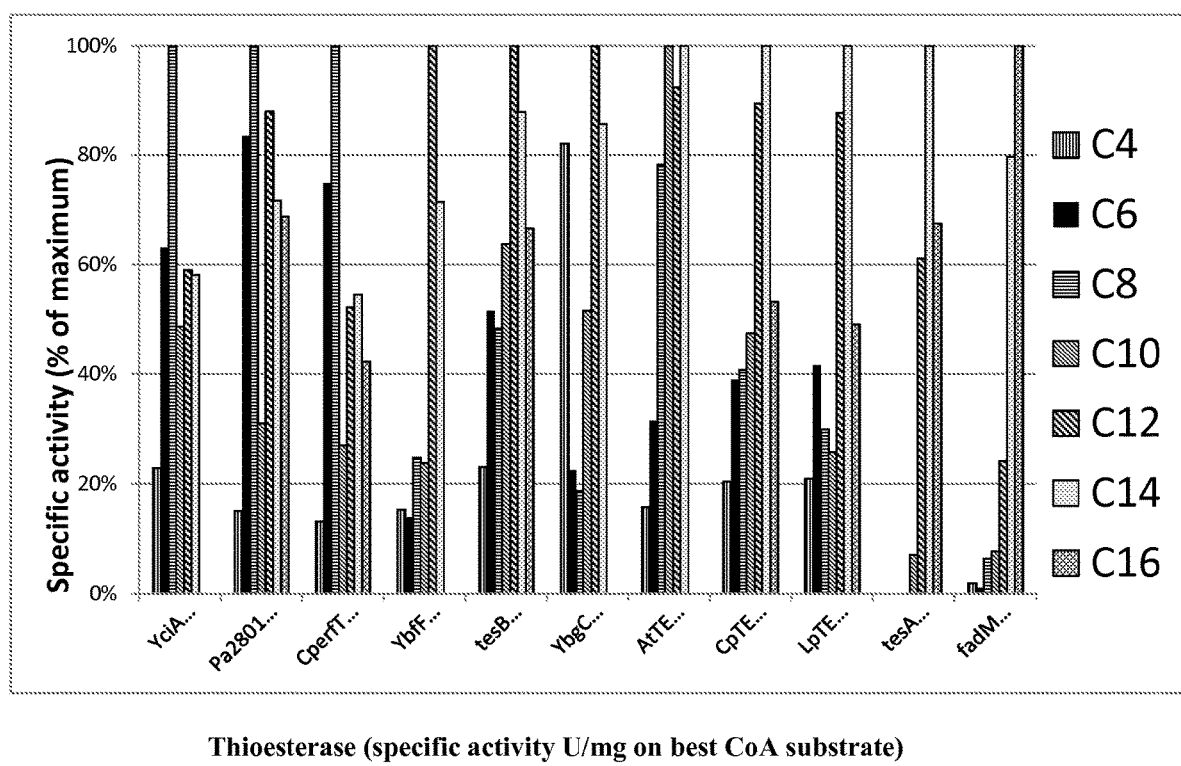
FIG. 16 is a bar chart showing activity of thioesterases on acyl-CoA substrates of different carbon chain lengths.

A further approach to chain length specificity can be achieved by targeting the release of fatty acids from the acyl-CoA precursor. The genes encoding a variety of thioesterases were synthesized using codons optimized for expression in E. coli by a commercial DNA synthesis provider (DNA2.0) and the genes expressed. Purification of the enzymes was enabled by affinity chromatography based on the N-terminal 6His affinity tag. The activity of this variety of thioesterases on acyl-CoAs of different chain lengths was assessed (FIG. 16). Thus while thioesterase PA2801TE has broad specificity from C6-CoA to C16-CoA, thioesterase 'tesA has no detectable activity on acyl-CoAs shorter than C10, and is minimally active on C10-CoA.

Thus the incorporation of an NphT7 variant, a FabH with the desired specificity as shown in Table 20, and the appropriate thioesterase as shown in FIG. 16 into a recombinant organism along with the enzymes that comprise an engineered fatty acid pathway enables the targeted production of fatty acids with specified chain lengths.

Example 4—Shake Flask Free Fatty Acid (FFA) Productions

A number of genetically modified E. coli strains were evaluated for production of free fatty acids. These strains comprise an engineered host based on strain BW25113 and with the additional genetic modifications: ΔldhA::frt, ΔpflB::frt, ΔmgsA::frt, ΔpoxB::frt, Δpta-ack::frt; a temperature-sensitive allele of fabI (fabI" S241F); and the additional modifications: Δtig::frt, ΔatoDAEB::frt, AfadD::frt that minimize diversion of acyl-CoA substrates or fatty acid products. Genes encoding NphT7, one or more thioesterases, a keto-CoA reductase (KCR), a 3-hydroxy-acyl-CoA dehydratase (3HDh), and an enoyl-CoA reductase (EnCr) are also provided on plasmids. The genes present in samples 1-5 are depicted in Table 21.

TABLE 21

Genes Present in Samples 1-5

| Strain Sample | 3-ketoacyl-CoA synthase | Thio-esterases | KCR | 3HDh | EnCr |
|---|---|---|---|---|---|
| Sample 1 (control) | NphT7 (SEQ ID NO 1) | none | | | |
| Sample 2 | NphT7 (SEQ ID NO 1) | 'tesA (SEQ ID NO 277) | Hbd (SEQ ID NO 271) | Crt (SEQ ID NO 272) | Ter (SEQ ID NO 275) |
| Sample 3 | NphT7 (SEQ ID NO 1) | FadA (SEQ ID NO 182) 'tesA (SEQ ID NO 278) | FadB (SEQ ID NO 183) | FadB (SEQ ID NO 183) | Ter (SEQ ID NO 275) |
| Sample 4 | NphT7 (SEQ ID NO 1) | 'tesA (SEQ ID NO 278) | FadB (SEQ ID NO 183) | FadB (SEQ ID NO 183) | Ter (SEQ ID NO 275) |
| Sample 5 | NphT7 (SEQ ID NO 1) | 'tesA (SEQ ID NO 278) | FadB (SEQ ID NO 183) | FadB (SEQ ID NO 183) | Ter (SEQ ID NO 275) fadE (SEQ ID NO 180) |

Figure 17:
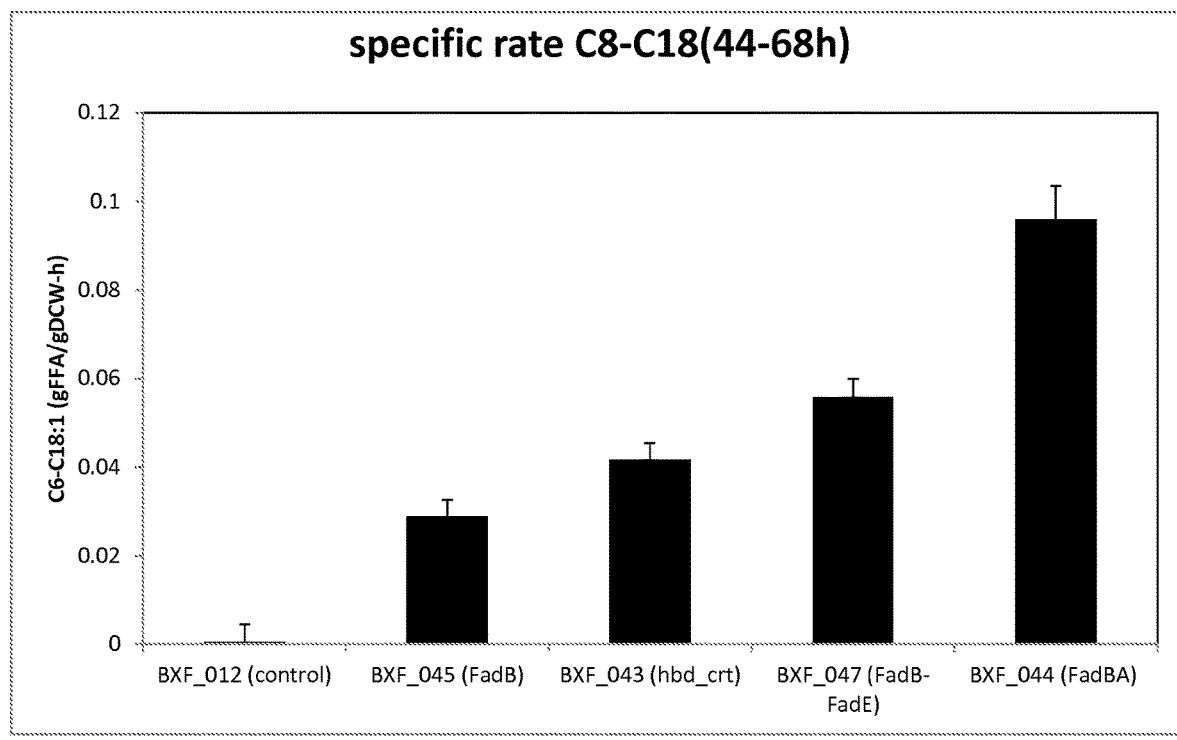
FIG. 17 is a bar chart showing production rates of C8-C18 free fatty acids produced in different bacteria strains.
Figure 18:
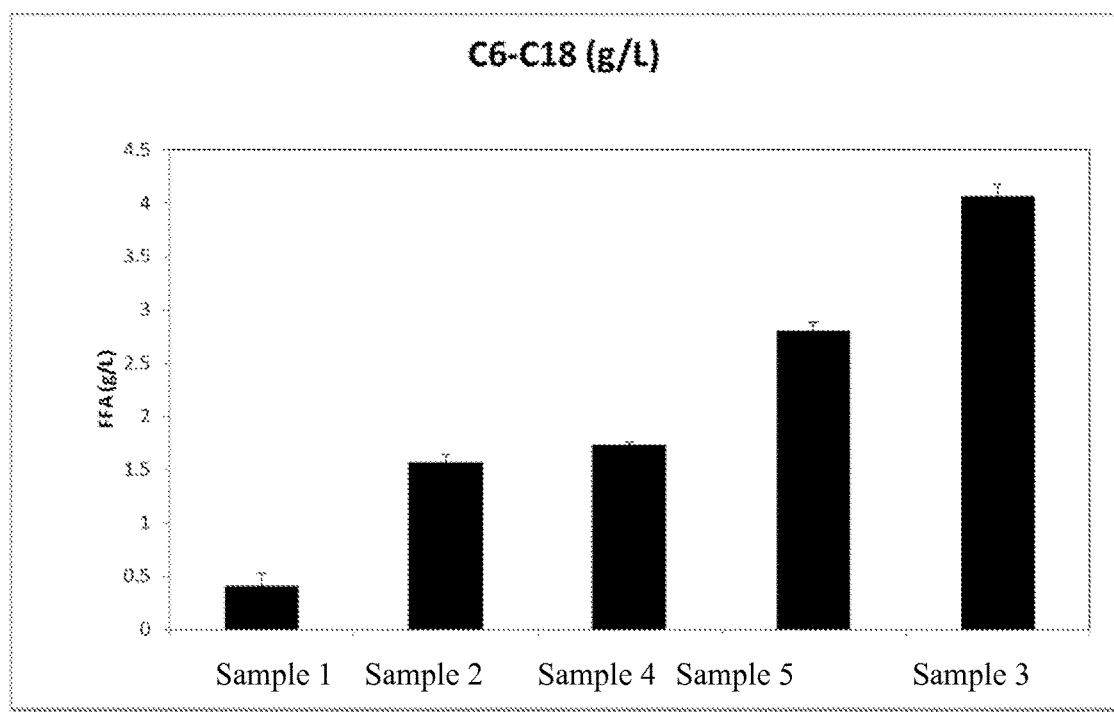
FIG. 18 is a bar chart showing titers of C6-C18 free fatty acids produced in different bacteria strains.
Figure 19:
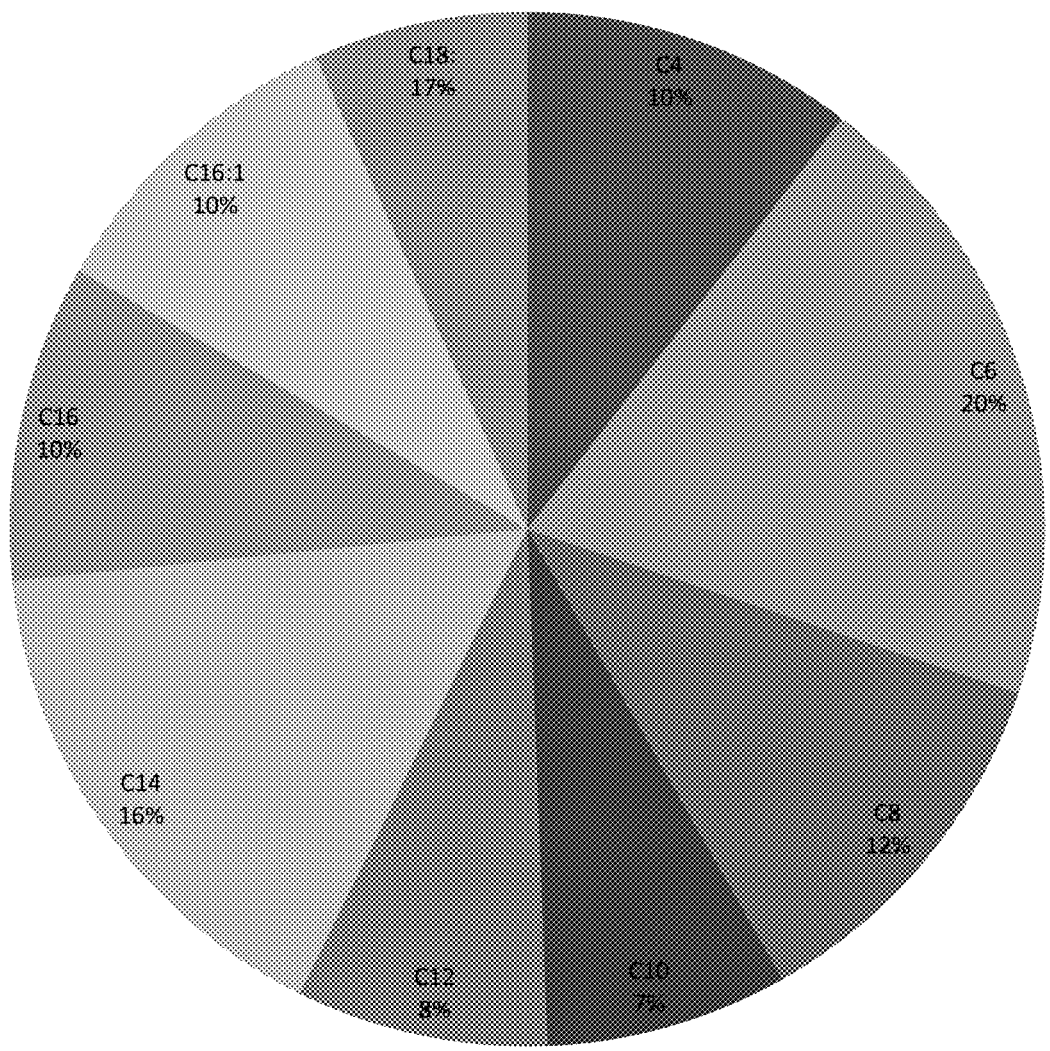
FIG. 19 is a pie chart showing the chain length specificity distribution of free fatty acids produced in strain sample 3.

The rate of producing C8-C18 FFA by these samples is shown in FIG. 17 and the titers for C6-C18 FFA production is shown in FIG. 18. The distribution of chain length specificity with strain sample 3 is shown in FIG. 19; 36% of the product is C14-C16 FFA. These results demonstrate that increased fatty acid production is achieved in these engineered strains, with a titer of 4.07 g/L by Sample 3.

Alternative KCRs, 3HDh, and EnCr enzymes may be used to provide the requisite activities to convert the keto-acyl-CoA product of NphT7, NphT7 mutants, or fabH homologs to the fully saturated product elongated by 2 carbons, viz. the reduction of the keto-acyl-CoA to 3-hydroxyacyl-CoA by KCR, the dehydration of the 3-hydroxyacyl-CoA to the enoyl-CoA by 3HDh, and the reduction of the enoyl-CoA to acyl-CoA by EnCr. For example, alternative KCRs including FadIJ, Hbd, and FadB. FadB has sufficient activity as a KCR up to C16 (See the Table 22 below).

TABLE 22

Activity of FadB on 3-hydroxyacyl-CoAs of different chain lengths

| Substrate | Specific Activity (U/mg) |
|---|---|
| 3-OH—C4-CoA | 0.4321 |
| 3-OH—C6-CoA | 0.585 |
| 3-OH—C8-CoA | 0.1255 |
| 3-OH—C10-CoA | 0.1777 |
| 3-OH—C12-CoA | 0.1935 |
| 3-OH—C14-CoA | 0.2564 |
| 3-OH—C16-CoA | 0.1158 |

Figure 20:
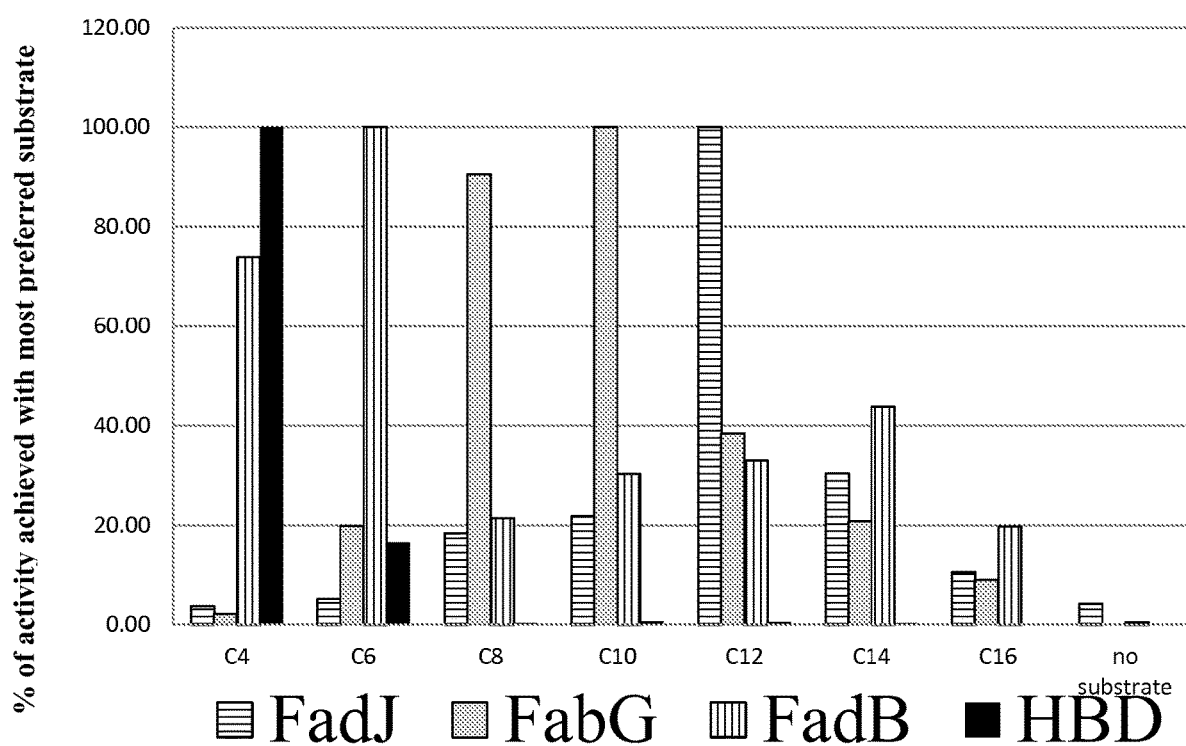
FIG. 20 is a bar chart showing the chain length specificity preference of different 3HDh.

Alternative 3HDhs including the bifunctional FadB, FabG, FadJ, and Hbd were tested for activity and product specificity. The results are shown in FIG. 20 expressed as percent of the activity achieved with the most preferred substrate.

To prevent consumption of the fatty acid product and to maintain chain length specificity, additional host genetic modifications to eliminate thioesterases may be required. These modifications include deletion or modulation of tesB (SEQ ID NO 279), yciA (SEQ ID NO 280), fadM (SEQ ID NO 283), ybgC (SEQ ID NO 281), and ybfF (SEQ ID NO 282).

Example 5. Production of 3-Keto-$C_5$-CoA

It was demonstrated that odd chain length fatty acids can be produced using the genetically modified enzymes and methods of the present invention. In particular, it was demonstrated that the enzymes NphT7 and NphT7 mutants are active with propionyl-CoA as the primer and malonyl-CoA as the extender donor to generate C5 keto-acyl-CoA. The NphT7 variants and fabHs described herein would further extend the C5 keto-acyl-CoA to make longer chain odd-numbered fatty acid products.

Freshly purified His6-NphT7, His6-NphT7(I147T, F217V), His6-NphT7(I147S, F217V), and $His_6$-Hbd were used in all the experiments in this example. NphT7 reactions (200 µL) contained 100 mM Tris-HCl (pH 8), 5 mM $MgCl_2$, 1 mM malonyl-CoA, 1 mM primer CoA ($C_2$-, or $C_3$-CoA), and various concentrations of wild-type NphT7 or mutant enzymes. Reactions without any primer CoA but with malonyl-CoA were also run. Formation of $Mg^{2+}$-3-keto-acyl-CoA adduct was monitored at 303 nm, at 37° C. for 15 mM. NphT7-Hbd coupled reactions (200 µL) contained 100 mM Tris-HCl (pH 8), 0.75 mM NADH, 1 mM malonyl-CoA, 1 mM primer CoA (C2 or $C_3$-CoA), 10 µg of partially purified Hbd, and various concentrations of wild-type NphT7 or mutant enzymes. Reactions without any primer CoA but with malonyl-CoA were also run. Oxidation of NADH was followed at 340 nm, at 37° C. for 15 min. At the end of the 15-minute enzyme reactions, 100 µL of samples were removed from each reaction and immediately mixed with 25 µL acetonitrile to terminate enzyme reactions. The mixtures were incubated on ice for at least 15 min, followed by centrifugation at 3,220×g at 4° C. for 15 mM. Supernatants were saved for UPLC-MS/MS analyses for the detection of 3-keto- and 3-OH—C4 and $C_5$-CoA. In certain runs, the Hbd enzyme was also used to determine if keto-CoA produced could be reduced to hydroxyacyl-CoA. The experimental results are shown in Table 23.

TABLE 23

Summary of Substrates and Enzymes use in Experiment

| | | | Enzyme | | Amount of Products Produced (ppm) | | | |
|---|---|---|---|---|---|---|---|---|
| Runs | Substrate 1 | Substrate 2 | Synthase | Hbd | Synthase Amount (mg) | 3-keto-C4-CoA (851.6) | 3-OH—C4-CoA (853.6) | 3-keto-C5-CoA (865.6) | 3-OH—C5-CoA (867.6) |
| 1 | C2-CoA | M-CoA | NphT7 | No | 0.00404 | 587.1 | 35.9 | 0.1 | 0.1 |
| | | | | | 0.00202 | 393.3 | 25.8 | 0.1 | 0 |
| | | | | | 0.00101 | 282.4 | 22.1 | 0 | 0.1 |
| | | | | | 0.000505 | 123.3 | 17.2 | 0.1 | 0 |
| | | | | | 0.000253 | 61.9 | 15.4 | 0.1 | 0 |
| | | | | | 0 | 22.3 | 16.1 | 0 | 0 |
| 2 | C3-CoA | M-CoA | NphT7 | No | 0.00404 | 20 | 9.4 | 79.8 | 5.2 |
| | | | | | 0.00202 | 10.1 | 10.6 | 31.3 | 2.2 |
| | | | | | 0.00101 | 6.2 | 9.6 | 13.2 | 1 |
| | | | | | 0.000505 | 4.9 | 10.4 | 6.1 | 0.5 |
| | | | | | 0.000253 | 3.2 | 10.8 | 3 | 0.2 |
| | | | | | 0 | 3.6 | 11.5 | 1.1 | 0.1 |
| 3 | — | M-CoA | NphT7 | No | 0.00404 | 7.9 | 7.3 | 0.6 | 0.1 |
| | | | | | 0.00202 | 5.9 | 6.6 | 0.5 | 0 |
| | | | | | 0.00101 | 4.1 | 5.7 | 0.4 | 0 |
| | | | | | 0.000505 | 2.3 | 7.8 | 0.4 | 0 |
| | | | | | 0.000253 | 1.5 | 6.3 | 0.3 | 0 |
| | | | | | 0 | 1 | 10.3 | 0.3 | 0 |
| 4 | C2-CoA | M-CoA | NphT7 | Yes | 0.00404 | 25 | 421.3 | 0.1 | 0.1 |
| | | | | | 0.00202 | 17.5 | 220.6 | 0.1 | 0 |
| | | | | | 0.00101 | 16.8 | 87.8 | 0.1 | 0 |
| | | | | | 0.000505 | 17.6 | 34.7 | 0.1 | 0.1 |
| 5 | C3-CoA | M-CoA | NphT7 | Yes | 0.00404 | 4.1 | 15.4 | 1.6 | 46.8 |
| | | | | | 0.00202 | 2.3 | 9.1 | 1.4 | 13.1 |
| | | | | | 0.00101 | 1.8 | 8.2 | 1.4 | 3.8 |
| | | | | | 0.000505 | 1.3 | 6.8 | 1.1 | 1.6 |
| 6 | — | M-CoA | NphT7 | Yes | 0.00404 | 0.9 | 23.9 | 0.1 | 0 |
| | | | | | 0.00202 | 0.7 | 13 | 0.1 | 0 |
| | | | | | 0.00101 | 0.7 | 7 | 0.1 | 0 |
| | | | | | 0.000505 | 0.7 | 8.2 | 0.1 | 0 |
| 7 | C2-CoA | M-CoA | NphT7(I147T, F217V) | No | 0.146 | 613.6 | 33.8 | 0.1 | 0.1 |
| | | | | | 0.073 | 637.8 | 35 | 0.1 | 0.1 |
| | | | | | 0.0365 | 695.1 | 38.7 | 0.1 | 0.1 |
| | | | | | 0.01825 | 664.1 | 39.9 | 0.1 | 0.1 |
| | | | | | 0 | 26.6 | 10.7 | 0.1 | 0 |
| 8 | C3-CoA | M-CoA | NphT7(I147T, F217V) | No | 0.146 | 49.5 | 5.9 | 221.1 | 15.1 |
| | | | | | 0.073 | 43.2 | 6.5 | 232.2 | 16.1 |
| | | | | | 0.0365 | 42.5 | 6 | 250.7 | 17.9 |
| | | | | | 0.01825 | 28.3 | 4.9 | 237.9 | 15.8 |
| | | | | | 0 | 2.2 | 8.6 | 4.5 | 0.3 |
| 9 | — | M-CoA | NphT7(I147T, F217V) | No | 0.146 | 125.9 | 12.6 | 0.3 | 0.1 |
| | | | | | 0.073 | 169.1 | 9.7 | 0.3 | 0.1 |
| | | | | | 0.0365 | 176.7 | 10.1 | 0.3 | 0.1 |
| | | | | | 0.01825 | 88 | 12.1 | 0.3 | 0.1 |
| | | | | | 0 | 3.6 | 8.6 | 0.3 | 0 |

TABLE 23-continued

Summary of Substrates and Enzymes use in Experiment

| Runs | Substrate 1 | Substrate 2 | Enzyme Synthase | Hbd | Synthase Amount (mg) | 3-keto-C4-CoA (851.6) | 3-OH—C4-CoA (853.6) | 3-keto-C5-CoA (865.6) | 3-OH—C5-CoA (867.6) |
|---|---|---|---|---|---|---|---|---|---|
| 10 | C2-CoA | M-CoA | NphT7(I147T, F217V) | Yes | 0.146 | 99.7 | 568.8 | 0.1 | 0.6 |
|    |        |       |                      |     | 0.073 | 55.3 | 605.7 | 0.1 | 0.6 |
|    |        |       |                      |     | 0.0365 | 43.9 | 553.3 | 0.1 | 0.4 |
|    |        |       |                      |     | 0 | 16 | 15.9 | 0 | 0.4 |
| 11 | C3-CoA | M-CoA | NphT7(I147T, F217V) | Yes | 0.146 | 9.5 | 55.1 | 16.5 | 348.7 |
|    |        |       |                      |     | 0.073 | 6.3 | 45.5 | 14.9 | 330.3 |
|    |        |       |                      |     | 0.0365 | 4.7 | 47.1 | 13.8 | 351 |
|    |        |       |                      |     | 0 | 1.2 | 8.5 | 1.1 | 4.3 |
| 12 | — | M-CoA | NphT7(I147T, F217V) | Yes | 0.146 | 4.4 | 270.1 | 0.1 | 2.1 |
|    |        |       |                      |     | 0.073 | 4.7 | 302.5 | 0.2 | 1.5 |
|    |        |       |                      |     | 0.0365 | 1.6 | 148.6 | 0.1 | 1.1 |
|    |        |       |                      |     | 0 | 0.8 | 8.6 | 0.1 | 0.7 |
| 13 | C2-CoA | M-CoA | NphT7(I147S, F217V) | No | 0.01925 | 570.3 | 26.8 | 0.3 | 0.1 |
|    |        |       |                      |     | 0.009625 | 487 | 24.9 | 0.2 | 0.1 |
|    |        |       |                      |     | 0.004813 | 340.7 | 19.5 | 0.2 | 0.1 |
|    |        |       |                      |     | 0.002406 | 232.7 | 15.5 | 0.2 | 0 |
|    |        |       |                      |     | 0 | 20.9 | 10.2 | 0.2 | 0 |
| 14 | C3-CoA | M-CoA | NphT7(I147S, F217V) | No | 0.01925 | 33.1 | 5.4 | 247.1 | 18.4 |
|    |        |       |                      |     | 0.009625 | 14.6 | 6.2 | 173.5 | 11.8 |
|    |        |       |                      |     | 0.004813 | 6.6 | 6.2 | 107.2 | 7.5 |
|    |        |       |                      |     | 0.002406 | 3.9 | 6.6 | 67.1 | 4.7 |
|    |        |       |                      |     | 0 | 1.5 | 7.5 | 2.5 | 0.2 |
| 15 | — | M-CoA | NphT7(I147S, F217V) | No | 0.01925 | 121.9 | 8.7 | 0.2 | 0.1 |
|    |        |       |                      |     | 0.009625 | 88.3 | 8.6 | 0.2 | 0.1 |
|    |        |       |                      |     | 0.004813 | 40.2 | 8.1 | 0.2 | 0.1 |
|    |        |       |                      |     | 0.002406 | 13.6 | 6.3 | 0.1 | 0.1 |
|    |        |       |                      |     | 0 | 1.5 | 6.6 | 0.2 | 0.1 |
| 16 | C2-CoA | M-CoA | NphT7(I147S, F217V) | Yes | 0.01925 | 23.6 | 427.2 | 0.1 | 0.1 |
|    |        |       |                      |     | 0.009625 | 22.3 | 452.9 | 0.1 | 0.1 |
|    |        |       |                      |     | 0.004813 | 17.4 | 342.2 | 0.1 | 0.1 |
|    |        |       |                      |     | 0 | 18.2 | 14 | 0.1 | 0.1 |
| 17 | C3-CoA | M-CoA | NphT7(I147S, F217V) | Yes | 0.01925 | 3.4 | 36.8 | 10.9 | 333.6 |
|    |        |       |                      |     | 0.009625 | 2.5 | 32.6 | 7.1 | 306.4 |
|    |        |       |                      |     | 0.004813 | 2.1 | 18.5 | 2 | 204.4 |
|    |        |       |                      |     | 0 | 1 | 7.3 | 0.9 | 3.3 |
| 18 | — | M-CoA | NphT7(I147S, F217V) | Yes | 0.01925 | 2.3 | 268 | 0.1 | 1.4 |
|    |        |       |                      |     | 0.009625 | 0.7 | 92.8 | 0.1 | 0.8 |
|    |        |       |                      |     | 0.004813 | 0.8 | 23.5 | 0.1 | 0.6 |
|    |        |       |                      |     | 0 | 0.6 | 7.4 | 0.1 | 0.4 |

3-keto-C5-CoA was produced by NphT7 only when C3- and malonyl-CoA were present simultaneously (Table 23—Run 2). When NphT7 was coupled to Hbd, the majority of the 3-keto-C5-CoA was reduced to 3-OH-C5-CoA. These results indicated that wild-type NphT7 is capable of utilizing a C3-CoA as primer in synthesizing 3-keto-C5-CoA, and Hbd from *Clostridium acetobutylicum* is capable of reducing 3-keto-C5-CoA.

Reactions using either NphT7 (I147T, F217V) or NphT7 (I147S, F217V) mutants were similar to those obtained in wild-type NphT7 reactions. Both mutants could use C3-CoA as primer to produce 3-keto-C5-CoA, which was further reduced to 3-OH-C5-CoA in the presence of Hbd plus NADH (Table 23—Runs 7-18). With acetyl-CoA plus malonyl-CoA or malonyl-CoA alone, only 3-keto-C4-CoA was produced by these enzymes. Higher concentrations of products were detected in either NphT7 (I147T, F217V) or NphT7 (I147S, F217V) because more enzymes were used in these 2 reactions than the reactions with wild-type NphT7.

When 3-keto-C5-CoA concentrations were plotted against the amount of enzymes in each reaction, specific activities (average over 15 min) of NphT7, NphT7 (I147T, F217V), and NphT7 (I147S, F217V) were 0.3, 0.2, and 0.27 U/mg, respectively.

Production of odd chain fatty acids, such as fatty acids of C5, C7, C9, C11, C13, C15, and C17 in length, is made possible by the construction of recombinant strains carrying genes expressing NphT7 and/or an NphT7 mutant, a fabH with the desired chain length specificity, a KCR, a 3HDh, and an EnCr, and a terminating enzyme such as a thioesterase or an ester synthase with the desired chain length specificity, and providing a source of propionyl-CoA as the primer and malonyl-CoA as the extender.

Example 7. Production of C4 and C6 Fatty Acid

It was demonstrated that C4 and C6 fatty acids can be produced using the genetically modified enzymes and methods of the present invention. In particular, it was demonstrated that C4 and C6 fatty acids can be produced by microorganisms genetically modified to encode certain NphT7 mutant enzymes in combination with PA2801TE thioesterase. These amino acid modifications enable the condensation reaction of acyl-CoA (C4-CoA and C6-CoA) with malonyl-CoA. In particular, the genetically modified microorganism comprises one or more heterologous 3-ketoacyl-CoA synthases selected from the group comprising wild-type NphT7, a variant of NphT7 with the I147T and F217V mutations, or a variant of NphT7 with I147S and F217V mutations, and any combination thereof, and at least one of: a) a heterologous KCR, such as fadB; b) a heterologous 3HDh, such as a fadB, c) a heterologous EnCr, such as ter; and d) a thioesterase PA2801TE.

The following genetically modified *E. coli* strains were evaluated for production of free fatty acids:

TABLE 24

Genetic Modifications of Test Strains

| Strain | Synthase/thiolase | KCR | 3HDh | EnCr | thioesterase | Host Genotype* | Plasmid 1 | Plasmid 2 |
|---|---|---|---|---|---|---|---|---|
| A | nphT7 (SEQ ID NO 1) fadA (SEQ ID NO 182) | fadB(SEQ ID NO 183) | | Ter (SEQ ID NO 275) | 'tesA (SEQ ID NO 278) | 1 | pACYC-PpstsIH-nphT7-ter TT-PpstsIH 'tesA | pET-PpstsIH-fadBA-TT |
| B | nphT7(SEQ ID NO 1) fadA(SEQ ID NO 182) | fadB(SEQ ID NO 183) | | ter (SEQ ID NO 275) | 'tesA (SEQ ID NO 278) | 2 | pACYC-PpstsIH-nphT7-ter TT-PpstsIH 'tesA | pET-PpstsIH-fadBA-TT- |
| C | nphT7(SEQ ID NO 1) | fadB(SEQ ID NO 183) | | ter (SEQ ID NO 275) | NONE | 2 | pACYC-PpstsIH-nphT7-ter TT-PpstsIH-fadB | pET-PpstsIH-empty vector |
| D | nphT7(SEQ ID NO 1) | fadB(SEQ ID NO 183) | | ter (SEQ ID NO 275) | PA2801TE (SEQ ID NO 288) | 2 | pACYC-PpstsIH-nphT7-ter TT-PpstsIH fadB | pET-PpstsIH-PA2801TE |
| E | nphT7(SEQ ID NO 1) npht7(I147T, F217V) | fadB(SEQ ID NO 183) | | ter (SEQ ID NO 275) | PA2801TE (SEQ ID NO 288) | 2 | pACYC-PpstsIH-nphT7-ter TT-PpstsIH fadB | pET-PpstsIH-NphT7(I147T, F216V)-PA2801TE |
| F | nphT7(SEQ ID NO 1) npht7(I147T, F217V) | fadB(SEQ ID NO 183) | | ter (SEQ ID NO 275) | PA28018TE (SEQ ID NO 288) | 2 | pACYC-PpstsIH-nphT7-ter TT-PpstsIH fadB | pET-PpstsIH-NphT7(I147T, F216V)-PA2801TE |

*Genotype 1: F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI(ts)-(S241F)-zeoR, Δtig::frt, ΔatoDAEB::frt, ΔfadD::frt, ΔtesB::frt, ΔyciA::frt

Figure 21:
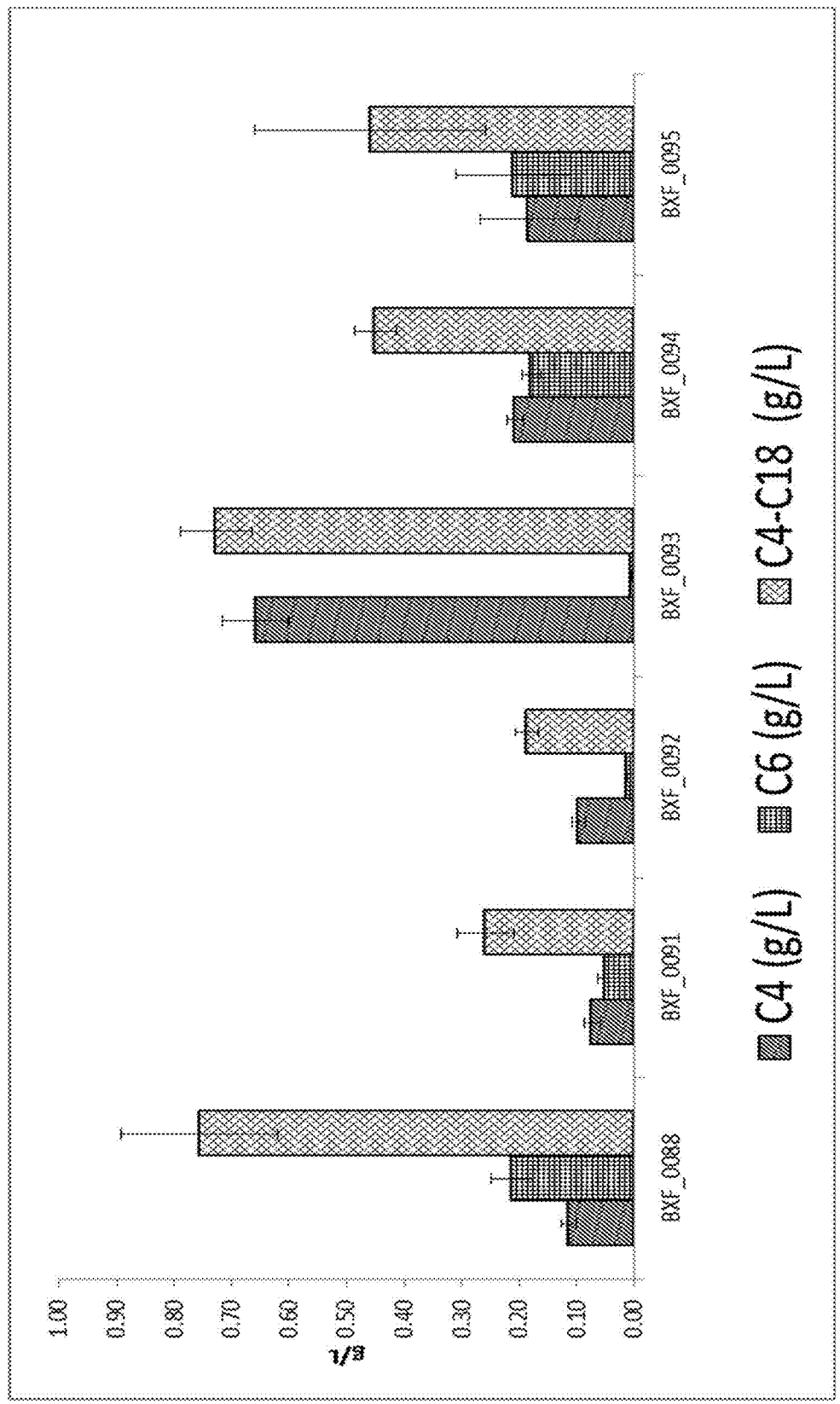
FIG. 21 is a graph showing the fatty acid carbon chain length distribution produced by various microorganisms in accordance with the present invention.
Figure 22:
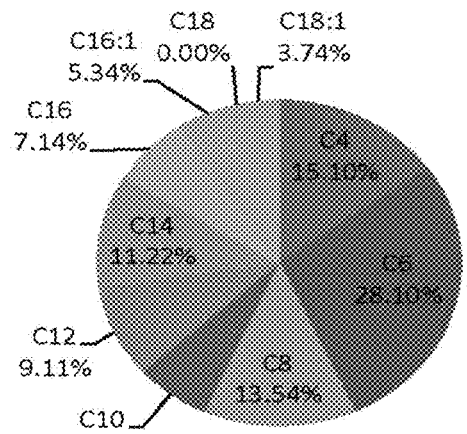
FIG. 22 includes a series of pie charts showing the fatty acid carbon chain length distribution produced by various microorganisms in accordance with the present invention.
Figure 22:
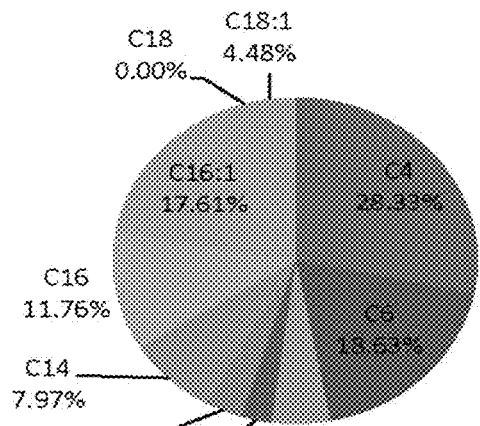
Figure 22:
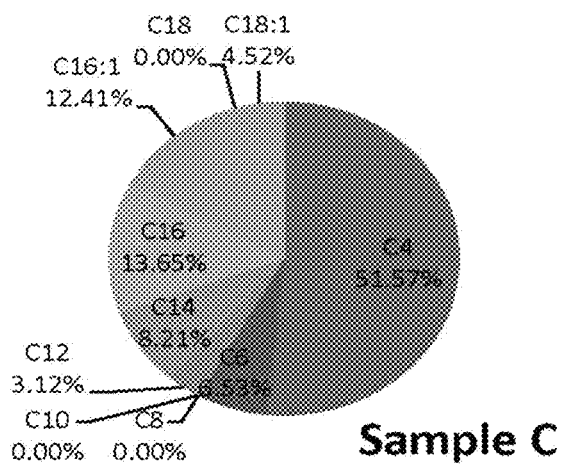
Figure 22:
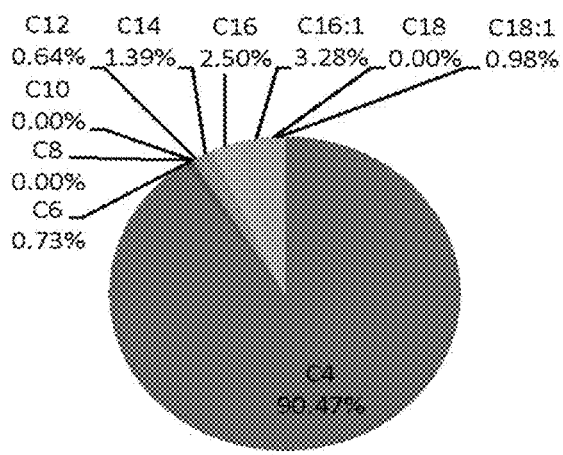
Figure 22:
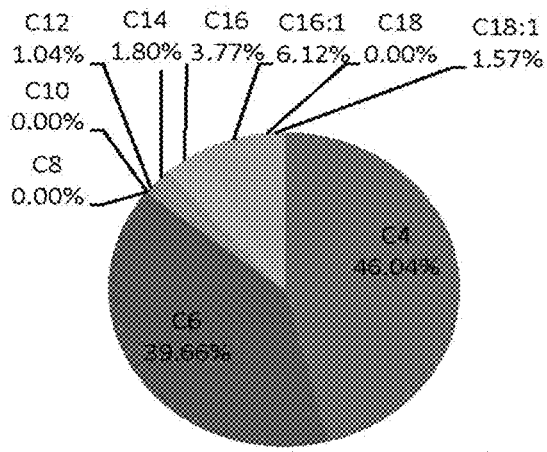
Figure 22:
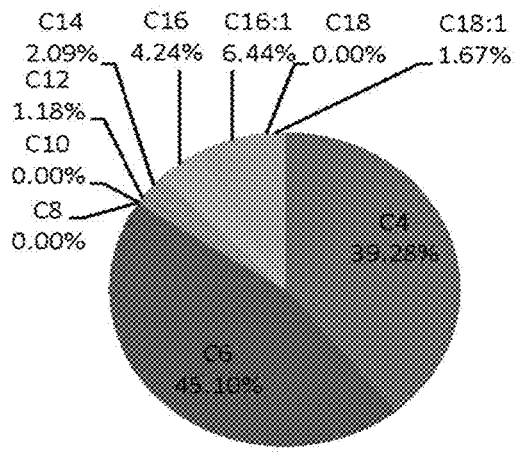

*Genotype 2: F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI(ts)-(S241F)-zeoR, fabB(ts), ΔfabF::frt, coaA*, fabD(ts), Δtig::frt, ΔatoDAEB::frt, ΔfadD::frt, ΔyciA::frt, ΔtesB::frt, ΔfadBA::frt, ΔfadIJ::frt, ΔybgC::frt, ΔybfF::frt A single colony was incubated at 30° C. for 20 hours in 150 ml SM11 with 35 µg/ml Kanamycin and 20 µg/ml Chloramphenicol. The cultures were transferred to 50 mL conical tubes and centrifuged at 4,000 RPM for 15 minutes. The pellets were resuspended in fresh SM11 (with phosphate) media to an optical density of 20. The resuspensions of each strain were combined, and 2.5 ml (5%) of the combined resuspensions was used to inoculate 50 ml of SM11 without phosphate media. The culture was incubated for 4 hours at 30° C., and thereafter the temperature was shifted to 37° C. After an additional 20 hours, samples were taken and analyzed for the amount of free fatty acid present. The amounts of C4, C6, and total free fatty acid measured as C4-C18 produced are shown in FIG. 21. In addition, samples were taken at the 18 hour time point post the temperature shift and analyzed for the free fatty acid distribution. The results of this analysis are shown in FIG. 22.

Example 8. Production of C4, C6 and C8 Fatty Acid

C4, C6 and $C_8$ fatty acids were produced using the genetically modified enzymes and methods of the present invention. In particular, $C_4$, $C_6$ and $C_8$ fatty acids were produced by microorganisms genetically modified to encode certain NphT7 mutant enzymes in combination with thioesterases. These amino acid modifications enable the condensation reaction of acyl-CoA (C2-CoA, C4-CoA, and C6-CoA) with malonyl-CoA. The genetically modified microorganism comprises one or more heterologous 3-ketoacyl-CoA synthases selected from the group comprising wild-type NphT7, or a variant of NphT7 with I147S and F217V mutations, and any combination thereof, and at least one of: a) a heterologous KCR, such as fadB; b) a heterologous 3HDh, such as a fadB, c) a heterologous EnCr, such as ter; and d) a thioesterase 'tesA.

The following genetically modified *E. coli* strains were evaluated for production of free fatty acids:

TABLE 25

Genetic Modifications of Test Strains

| Strain | Synthase | KCR | 3Hdh | EnCr | thioesterase | Host Genotype | Plasmid(s) |
|---|---|---|---|---|---|---|---|
| G | nphT7(SEQ ID NO 1) | fadB(SEQ ID NO 183) | | ter(SEQ ID NO 275) | 'tesA (SEQ ID NO 278) | F-, Δ(araD-araB)567, ΔlacZ4787(::rrnB-3), LAM-, rph-1, Δ(rhaD-rhaB)568, hsdR514, | pACYC_PpstsIH-npht7-ter_PpstsIH-'tesA pET-PpstsIH- |

TABLE 25-continued

Genetic Modifications of Test Strains

| Strain | Synthase | KCR | 3Hdh | EnCr | thioesterase | Host Genotype | Plasmid(s) |
|---|---|---|---|---|---|---|---|
| | | | | | | ΔldhA::frt, ΔpflB::frt, ΔmgsA::frt, ΔpoxB::frt, Δpta-ack::frt, fabI(ts)-(S241F)-zeoR, fabB(ts), ΔfabF::frt, coaA*, fabD(ts), Δtig::frt, ΔatoDAEB::frt, ΔfadD::frt, ΔyciA::frt, ΔtesB::frt, ΔfadBA::frt, ΔfadIJ::frt | FadB |
| H | nphT7(SEQ ID NO 1) nphT7(I147S-F217V) | fadB(SEQ ID NO 183) | ter(SEQ ID NO 275) | | NONE | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI(ts)-(S241F)-zeoR, fabB(ts), ΔfabF::frt, coaA*, fabD(ts), Δtig::frt, ΔatoDAEB::frt, ΔfadD::frt, ΔyciA::frt, ΔtesB::frt, ΔfadBA::frt, ΔfadIJ::frt, ΔybgC::frt | pACYC_PpstsIH-nphT7-ter-TT-PpstsIH-fadB pET_PpstsIH-His-nphT7(I147S-F217V) |
| I | nphT7(SEQ ID NO 1) nphT7(I147S-F217V) | fadB(SEQ ID NO 183) | ter(SEQ ID NO 275) | | NONE | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI(ts)-(S241F)-zeoR, fabB(ts), ΔfabF::frt, coaA*, fabD(ts), Δtig::frt, ΔatoDAEB::frt, ΔfadD::frt, ΔyciA::frt, ΔtesB::frt, ΔfadBA::frt, ΔfadIJ::frt, ΔybgC::frt, ΔybfF::frt | pACYC_PpstsIH-nphT7-ter-TT-PpstsIH-fadB pET_PpstsIH-His-nphT7(I147S-F217V) |
| J | nphT7(SEQ ID NO 1) nphT7(I147S-F217V) | fadB(SEQ ID NO 183) | ter(SEQ ID NO 275) | | 'tesA (SEQ ID NO 278) | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI(ts)-(S241F)-zeoR, fabB(ts), ΔfabF::frt, coaA*, fabD(ts), Δtig::frt, ΔatoDAEB::frt, ΔfadD::frt, ΔyciA::frt, ΔtesB::frt, ΔfadBA::frt, ΔfadIJ::frt, ΔybgC::frt, ΔaldB::PpstsIH-'tesA-TT_loxP-BlsdR-loxP | pACYC_PpstsIH-nphT7-ter-TT-PpstsIH-fadB pET_PpstsIH-His-nphT7(I147S-F217V) |
| K | nphT7(SEQ ID NO 1) nphT7(I147S-F217V) | fadB(SEQ ID NO 183) | ter | | 'tesA (SEQ ID NO 278) | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI(ts)-(S241F)-zeoR, | pACYC_PpstsIH-nphT7-ter-TT-PpstsIH-fadB pET_PpstsIH-His-nphT7(I147S-F217V) |

TABLE 25-continued

Genetic Modifications of Test Strains

| Strain | Synthase | KCR | 3Hdh | EnCr | thioesterase | Host Genotype | Plasmid(s) |
|---|---|---|---|---|---|---|---|
| | | | | | | fabB(ts), ΔfabF::frt, coaA*, fabD(ts), Δtig::frt, ΔatoDAEB::frt, ΔfadD::frt, ΔyciA::frt, ΔtesB::frt, ΔfadBA::frt, ΔfadIJ::frt, ΔybgC::frt, ΔybfF::frt, ΔaldB::PpstsIH-'tesA-TT_loxP-BlsdR-loxP | | coaA* denotes an allele of coaA (pantothenate kinase) which is resistant to feedback inhibition.

Figure 23:
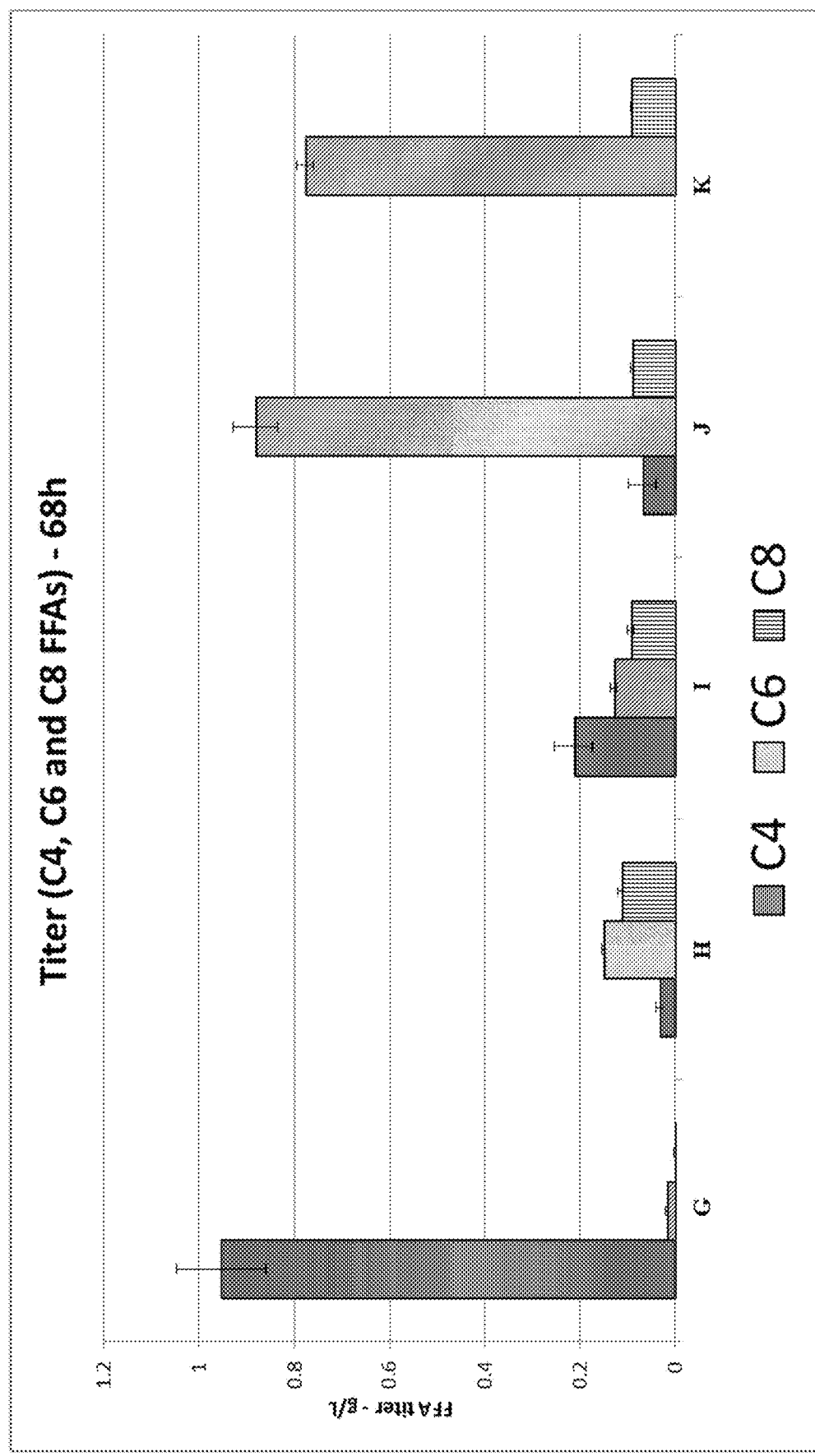
FIG. 23 is a bar chart showing the amounts of C4, C6, and C8 free fatty acid produced by various genetically modified microorganisms in accordance with the present invention.
Figure 24:
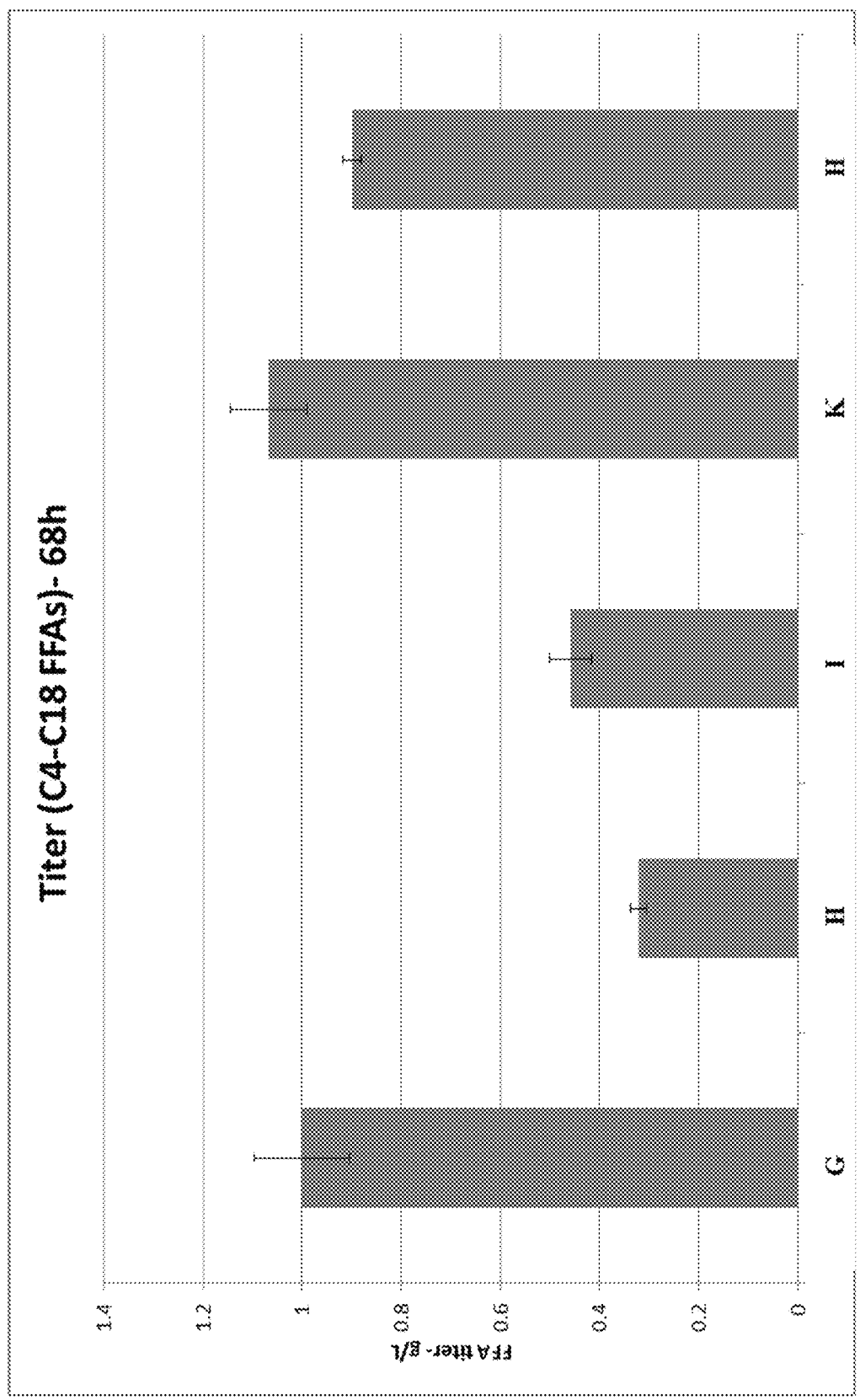
FIG. 24 is a bar chart showing the amounts of total fatty acids (C4-C18) produced by various genetically modified microorganisms in accordance with the present invention.
Figure 25:
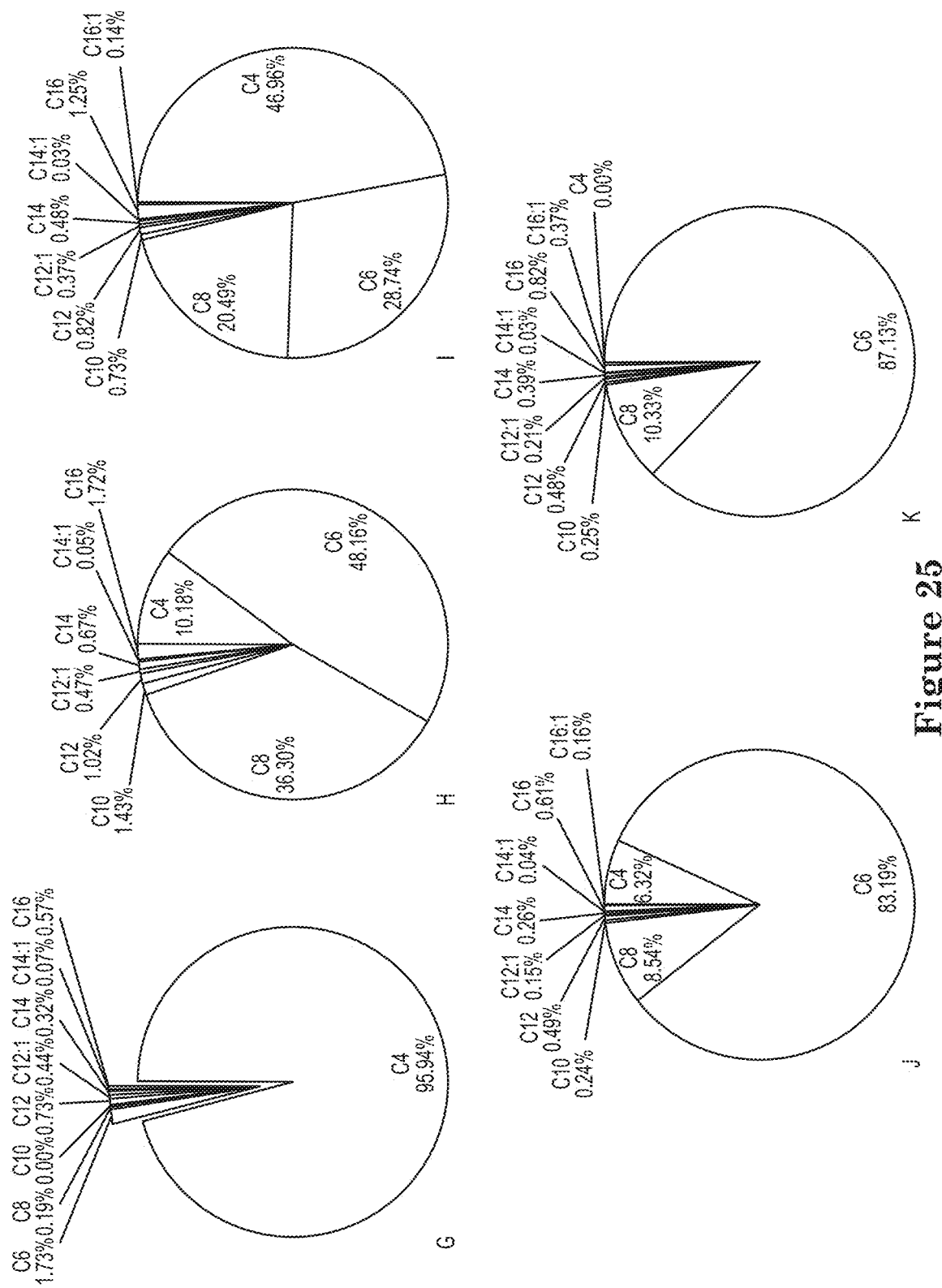
FIG. 25 includes a series of pie charts showing the distribution of free fatty acids produced by various genetically modified microorganisms in accordance with the present invention.

The same method outlined in Example 7 was used, however the culture was allowed to ferment for 68 hours post temperature shift and samples were taken and analyzed for the amount of free fatty acid present. The amounts of C4, C6, and C8 free fatty acid produced are shown in FIG. 23 and the amounts of total fatty acids (C4-C18) produced are shown in FIG. 24. The distribution of free fatty acids produced by the various strains is shown in FIG. 25. These results indicate that strains J and K produce C6-fatty acids with high specificity.

Production of fatty acids of chain length >C8, such as C10, C12, C14, C16, and C18 fatty acids in length with high specificity, is made possible by the construction of recombinant strains carrying genes expressing NphT7 and/or an NphT7 mutant, a fabH with the desired chain length specificity, a KCR, a 3HDh, and an EnCr, and a terminating enzyme such as a thioesterase or an ester synthase with the desired specificity, and providing a source of acetyl-CoA as the primer and malonyl-CoA as the extender.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention.

SEQUENCE LISTING (304 sequences)

SEQ ID NO: 1 - protein, 329 aa, Streptomyces sp.
MTDVRFRIIGTGAYVPERIVSNDEVGAPAGVDDDWITRKTGIRQRRWAADDQATSDLATAAGRAALKAAGITPEQLTVIAVATSTPDRPQPPTAAYVQHHLGATGTAAFDVNAVCSGTVFALSSVAGTLVYRGGYALVIGADLYSRILNPADRKTVVLFGDGAGAMVLGPTSTGTGPIVRRVALHTFGGLTDLIRVPAGGSRQPLDTDGLDAGLQYFAMDGREVRRFVTEHLPQLIKGFLHEAGVDAADISHFVPHQANGVMLDEVFGELHLPRATMHRTVETYGNTGAASIPITMDAAVRAGSFRPGELVLLAGFGGGMAASFALIEW

SEQ ID NO: 2 - DNA, 2137 bp, Streptomyces sp.
cctgcaggccgtcgagggcgcctggaaggactacgcggagcaggacggccggtcgctggaggagttcgcggcgttcgtctaccaccagccgttcacgaagatggcctacaaggcgcaccgccacctgctgaacttcaacggctacgacaccgacaaggacgccatcgagggcgccctcggccagacgacggcgtacaacaacgtcatcggcaacagctacaccgcgtcggtgtacctgggcctggccgccctgctcgaccaggcggacgacctgacgggccgttccatcggcttcctgagctacggctcgggcagcgtcgccgagttcttctcgggcaccgtcgtcgccgggtaccgcgagcgtctgcgcaccgaggcgaaccaggaggcgatcgcccggcgcaagagcgtcgactacgccacctaccgcgagctgcacgagtacacgctcccgtccgacggcggcgaccacgccaccccggtgcagaccaccggccccttccggctggccgggatcaacgaccacaagcgcatctacgaggcgcgctagcgacacccctcggcaacggggtgcgccactgttcggcgcaccccgtgccgggctttcgcacagctattcacgaccatttgaggggcgggcagccgcatgaccgacgtccgattccgcattatcggtacgggtgcctacgtaccggaacggatcgtctccaacgatgaagtcggcgcgccggccggggtggacgacgactggatcacccgcaagaccggtatccggcagcgtcgctgggccgccgacgaccaggccacctcggacctggccacggccgcggggcgggcagcgctgaaagcggcgggcatcacgcccgagcagctgaccgtgatcgcggtcgccacctccacgccggaccggccgcagccgcccacggcggcctatgtccagcaccacctcggtgcgaccggcactgcggcgttcgacgtcaacgcggtctgctccggcaccgtgttcgcgctgtcctcggtggcgggcaccctcgtgtaccggggcggttacgcgctggtcatcggcgcggacctgtactcgcgcatcctcaacccggccgaccgcaagacggtcgtgctgttcggggacggcgccggcgcaatggtcctcgggccgacctcgaccggcacgggccccatcgtccggcgcgtcgccctgcacaccttcggcggcctcaccgacctgatccgtgtgcccgcgggcggcagccgccagccgctggacacggatggcctcgacgcgggactgcagtacttcgcgatggacgggcgtgaggtgcgccgcttcgtcacggagcacctgccgcagctgatcaagggcttcctgcacgaggccggggtcgacgccgccgacatcagccacttcgtgccgcatcaggccaacggtgtcatgctcgacgaggtcttcggcgagctgcatctgccgcgggcgaccatgcaccggacggtcgagacctacggcaacacgggagcggcctccatcccgatcaccatggacgcggccgtgcgcgccggttccttccggccgggcgagctggtcctgctggccgggttcggcggcggcatggccgcgagcttcgccctgatcgagtggtagtcgcccgtaccaccacagcggtccggcgccacctgttccctgcgccgggccgccctcggggcctttaggccccacaccgccccagccgacggattcagtcgcggcagtacctcagatgtccgctgcgacggcgtcccggagagcccgggcgagatcgcgggcccccttctgctcgtccccggcccctcccgcgagcaccacccgcggcggacggccgccgtcctccgcgatacgccgggcgaggtcgcaggcgagcacgccggacccggagaagccccccagcaccagcgaccggccgactccgtgcgcggccagggcaggctgcgcgccgtcgacgtcggtgagcagcaccaggagctcctgcggcccggcgtagaggtcggccagccggtcgtagcaggtcgcgggcgcgcccggcggcgggatcagacagatcgtgcccgcccgctcgtgcctcgccgcccgcagcgtgaccagcggaatgtcccgcccagctccgga

SEQ ID NO: 3 - protein, 324 aa, Clostridium perfringens
MKNAKMIGFGLYTPKNLVENERLQEFLETSDEWIRTRTGIERRYISLDENTSDLAVEASKKALSQARLSAEEIDLIIVATVTPDNFTPSTACIVQDKLGAKNAWAFDINAACTGFIYALKLGRSLIRSGEANNALIIGAETLSKALNWEDRGSCVLFGDGAGATVLTSTEEDCGIKCVNVKSDGSKGDSLVIQGLPLNSPFKDGREVSENYINMNGREIFKFATKVMEESIVEILEKENIKIEDIAAIIPHQANLRIIDYVVKRLGIPREKFITNLQNYGNTSGASIPIALCESIDEGNLKKGDNIIMVGFGGGLTWGAALIKL

SEQ ID NO: 4 - protein, 316 aa, Streptomyces coelicolor
MHQGSRITAVGHYQPARILTNEDLAGMVDTSDEWIRSRVGIRTRRIAGPDEPVDELAGHAAAKALASAGLTPADVDLVVVATSTAIDRSPNTAARVAARLGIPGPAALDLNVVCAGFTHALATADHAVRAGSASRALVVGADKMSEVVDWTDRTTCVLVGDGAGAAVVEACAPGEEPGIGPVLWGSVPEMGNAVRIEGTPPRFAQEGQSVYRWATTRLPAIARQACERSGLEPADLAAVVLHQANLRIVEPLAAKIGAVNAVVARDVVESGNTSAASIPLALSKLAERGEITTGDPALLFGFGGNLSYAGQVVRCP

SEQ ID NO: 5 - protein, 324 aa, Magnetospirillum magnetotacticum
MIVRSQIIGCGSYLPSRLVTNAELAAKVDTTDEWIVERSGIRQRHIAAEGETTSDLATNAALRALEAAGIAGSAVDLVIVATATPDNTFPATATKVQSRIGMKHGFAFDVQAVCSGFVYALSVADNFIKSGQVQTALVIGAETFSRILDWNDRTTCVLFGDGAGAVVLRANRGKGSSADRGILSTHLHSDGSHYDLLYVDGGPSSTQTVGHVHMEGREVFRHAVINLASVVGEALSANDLKASDIDWVVPHQANRRIIEGTAKKLGFPLDKMVMTVDRHANTSAASIPLALTEAVSDGRIKPGQLVLLEAMGGGFTWGSALVRM

SEQ ID NO: 6 - protein, 316 aa, Vibrio parahaemolyticus
MYSKILGTGSYLPSQVRTNADLEKMVDTSDEWIVARTGIKERRIAAEDETVADMAFYAAENAIDMAGIDKNDIDLIIVATTSSSHTFPSSACQVQAKLGIKGCPAFDLAAACSGFVYALSVADQHIKSGMCKNVLVIGADALSKTCDPTDRSTIILFGDGAGAVVVGASQEPGIISTHIYADGQFGDLLSLPVPERGKDVDKWLHMAGNEVFKVAVTQLSKLVKDTLEANDMHKSELDWLVPHQANYRIISATAKKLSMSLDQVVVTLDRHGNTSAATVPTALDEAVRDGRIKRGQTLLLEAFGGGFTWGSALVKF

SEQ ID NO: 7 - protein, 310 aa, Geobacillus kaustophilus
MGAGIIGVGRYVPEKVLTNFDLEKMMDTSDEWIRTRTGIEERRIAADDIDTSDMAYFAAKRALQDAGMEAKDIDLILVATVTPDRPFPSVACMLQERLGAVNAAALDISAACAGFMYGMVTAAQFIDTGAYKYILVVGADKLSKITDWTDRNTAVLFGDGAGAVVMGPVSPGRGILSFELGADGTGGKHLYKDEYIVMNGREVFKFAVRQMGESSVRVLEKAGLTKDDVDFLIPHQANIRIVEAARQRLELPEEKISTTIRRYGNTSAASIPISLVEELEAGKIHDDDLIIMVGFGGGLTWGAIALRWGR

SEQ ID NO: 8 - protein, 308 aa, Bacillus anthracis
MGILGIGRYVPEKVVTNHDLEKIMDTSDEWIRTRTGIAERRIADDTIDTSYMAVEASKKALEDAGISGEDIDLILVATVTPDRAFPAVACVIQEAIGAKHAAAMDLSAACAGFMYGMITAQQFIQTGTYKNVLVVGSDKLSKIVDWNDRNTAVLFGDGAGAIVMGAVSEGKGVLSFELGADGSGGKHLYQDEYVMMNGREVFKFAVRQLGDSCLRVLDKAGLTKEDVDFLVPHQANIRIMESARERLNLPQEKMSMTIEKFGNTSASSIPIAMVEELQNGRIQDGDLIILVGFGGGLTWGAVALRWGK

SEQ ID NO: 9 - protein, 326 aa, Anaeromyxobacter dehalogenans
MRSLIAGTGSYAPEKVVTNADLEKLVDTNDQWIVERTGIRERHVVADDQATSDLALEASRRALDAAGLDAKDVEMIVVGTVTPDYPFPSVGAVLQGKLGNKKAFAFDVSAACAGSLYALSVADRFVASGAVKNALVVGADALTRITDWTDRNTCILFGDGAGAMVLKPTDDPQRGIRAVRLHADGSLVPILLQPGGGSRDPISEKVVREKSHYVKMNGREVFKVAVRSLEESCREVLADEKLTPGDVTWVIAHQANKRILDATLHRLEIPESKCWMNLEKYGNTSAASVPMTLDEANRAGWLKPGDTVLMMAIGGGMAWGASVVRW

SEQ ID NO: 10 - protein, 381 aa, Psychrobacter cryohalolentis
MTTCITGTGLYIPPFSISNEELVESFNQYVEKYNTKHAADIEAGTLTALQPSSAAFIEKVSGIKSRYVMEKDGILNPDIMAPVIAYRNLGEELSIMAEMGVAALNDALADAGLEANDLDGIILACSNFQRTYPAVSIEIQNAIGMVGGFAYDMNVACSAATFGLSQAHGSIASGLAKRVAVVNVEITSAHLNWRNRDSHFIFGDVATACIVEELDTPKGYEILNSKLFTQFSTNIKNEYGFMDRSEFLAAQTEMYPDIKEPVTDKLFLQNGRKVFREVCPKVSEVITEHLQENNIATSDVKMMWLHQANANMLDLILRTVIGKEADKAIVPSVIAEFANTSSASPMIVFHRYKDDLASGDLGVICSFGAGYSIGSVIVRKV

SEQ ID NO: 11 - protein, 374 aa, Pseudoalteromonas atlantica
MTNSVVISGSGLWNPPHSISNEELVDAYNAYAQQFNEQNADEIESGAITAKPFSSAEFIQKASGIRSRYCYMKDGVLDINRMRPIIPERGEEELSDQAEMAINAAKLALEAANKTAEDIDVVIVSCAYTQRSYPALAIEVQGALGIKGFGFDMLVACSAATFALHRAYEMISAGTAKGVLVINPELTSPQVNYCDRDSHFIFGDVATAMVVEHADTATSEHVFDILSTKAITQYSNNIRSNFGYVSRANDVDPYGADKLFHQEGRKVFKEVCPMAAEHISEHLERHQLTSADVKRWWLHQANINMNTLISKRLLGREATVEEAPIVLDRYANTASAGSIIAFNLHHKDLQAGDYGLLCSFGAGYSIGSLLVRKR

SEQ ID NO: 12 - protein, 319 aa, Shewanella sp.
MHTKILGTGSYLPVQVRSNQDLEKMVETSDQWIVERTGISERRIAAQDETVSTMGYQAALKALEMAGIEASELDMIICGTTSAANAFPAAACEIQAMLGVHTIPAFDIAAACSGFVYALSVADQFVKNGTAKKVLVIGADVLSRLCEPEDRTTIILFGDGAGAAVIGASDEPGIISTHIYADGRQGDLLKCAFPPRQGETSEAVGFMTMKGNDVFKVAVTQLSHVVTETLRLNNIDKSEIDWLVPHQANFRIINATAKKLDMSLDKVVLTLAKHGNTSAASVPIALDEAVRDGRIQRGQLLLLEAFGAGFAWGSALVRF

SEQ ID NO: 13 - protein, 338 aa, Thermosinus carboxydivorans
MKANDIGVGILGLGCYVPEKVLTNHDLEKMVDTSDEWIVERTGIRERRIADPDVATSDLATRAAERALSNAGISADELDLIIVATATPDMFFPSVACLVQDNLKATRAAAFDLVAGCSGFVYGLTVGAQFIKTGLYKKVLVIGAETLSKILDWTDRNTCVLFGDGAGAAVLSETEPGYGLIGFHLGADGSGGDLLKLPAGGSRLPPSVETVTQRLHFVHMNGNEVFKFAVRVMGEAAVKALENAGLGHQDVDCLIPHQANIRIIQSAAKRLKLPMDKVIVNVDKYGNTSAASIPIALEEAVRNGRVKKGDVVVLVGFGAGLTWASCVIKWCKEDNTIA

SEQ ID NO: 14 - protein, 373 aa, Shewanella putrefaciens
MKQVVISGSGLFTPPYSISNEALVESFNAYVDIFNLENAGLIEQGHVAALSYSSSEFIEKASGIKHRYVMVKEGILDPEIMMPLIPERSSDELSMQAEIGVEAALMALNNANLKAEQIDLVIVACAYTQRAYPAMAIEIQRALGTRGYGYDMQVACSSATFAIVAAANAIATGSASRVLVINPEICSAQVNYRDRDSHFIFGDVATALVLEEQSLVEPNKGFTILSSRCFTDYSNNIRSNFGFLNRCDPSSAHQADKLFHQQGRKVFKELLPMIYQHLDEHLAEQASTPQSFKRLWLHQANINMNQFVVRKMLGDEVSPEQAPVVLDEYANTASAGSVIAFHKYSSDFKAGDLGLLSSFGAGYSIGSVILQKR

SEQ ID NO: 15 - protein, 325 aa, Delftia acidovorans
MRRYARITGTGSYLPPRRLTNHDLAAELAQRGIETSDEWIVERTGIHARHFAAPDVASSDLALEASKKALEAAGCQPQDIDLIIVATSTPDMVFPSTACILQNKLGANGCAAFDVQAVCSGFVYALTVADAMIQSGAASRALVVGSEVFSRILDFNDRTTCVLFGDGAGAVVLEASEQPGILASDLHADGKHVGILCVPGNVSGGQVLGDPLLKMDGQAVFKLAVGVLEKAARATLDKAGLTDADIDWLIPHQANIRIMQSTARKLKLSMDKVVVTVDQHGNTSAASIPLALDHGVRNGQVKPGQTVLLEGVGGGFTWGAVLLKM

SEQ ID NO: 16 - protein, 333 aa, Microcystis aeruginosa
MNGFGAAVVITGCGSATPAQFLSNEELSQIVETSDEWIKSRTGIGKRHLADRSVSLSQLAAQAAIKALEMAQVSPRDIDLILLATSTPDDLFGSAAQVQSQIGANRAIAFDLTAACSGFLVGLVTATQFIRTGTYRNVLVIGADVLSRWVDWNDRATCVLFGDGAGAVVCQANDTKDNILGFELHSDGSQNGSLNLAYEGEELPLKQGIRVQKGTYKPLRMNGREVYRFAVAKVPEVIEKALYRANLTTSDIDWLVLHQANQRIMDAVSERLKLPPEKVISNLSEYGNTSAASIPLALDEAVRSGKVKKGDIIASSGFGAGLTWGGIIFRWGD

SEQ ID NO: 17 - protein, 368 aa, Acinetobacter baumannii
MGIRITGTGLFHPTEIISNEELADSLNAYVEQYNQENAEKIAAGELEELRGSSAEFIEKASGIKRRYVIEKSGILDPTRLRPRLSERSNDELSIQAEWGVIAAKQAMENAGVTAEDIDVVILACSNMQRAYPAVAIEIQSALGIQGYAYDMNVACSAATFGLKQAADAIRSGARRVLLVNVEITSGHLDYRNRDCHFIFGDVATASIIEETTTKTGFEILDIHLFTQFSNNIRNNFGFLNRSEDAVVDDKLFRQDGRKVFKDVCPLVAKIINAQLEKMQLTANDIKRFWLHQANANMNELILKYVAGKDADLSRTPIILDEFANTSSAGVIIALHRTGHEVDDGEYGVISSFGAGYSVGSIVVQKHVA

SEQ ID NO: 18 - protein, 324 aa, Clavibacter michiganensis
MVERFTRIWGLGAARGELDVPNDDLVGPIDSSDEWIRQRTGIITRKRAGADVDAVDLATTASLEAIAKAGIRPEQIGIVLVSTVSNTVQTPSMAALLADRIGANPAPAYDISAACAGYTYGIAQADSFIRSGLAEYVLVVGAEKLSDIVDPTDRSISFLLGDGAGAAIVGPSDTPGISPTVWGSDGSNWDAVGMTGTLKSMRDGSAWPTLRQDGQKVFRWAVWEMVKVAKEALDRAGVAPEQLAAFIPHQANMRIVDEFAKQLGLPESVAIARDIATTGNTSAASIPLATHRLLEEDPSLSGGLALQIGFGAGLVFGAQVVVLP

SEQ ID NO: 19 - protein, 370 aa, Phenylobacterium zucineum
MNDAVIAATGLYTPPLSLSNAELVETFNAYVERFNAANAEAIARGEVQPLQPSSVEFIEKASGIKSRFVVDKTGLVDPEIMRPIIPERPNDQLSILAEIAVEAAKDAIARWGKPVSEIDAVICAASNMQRAYPAMAIEVQQALGIDGFAFDMNVACSSATFGIKTAADFVAGGAKAVLMVNPEICSGHLNFRDRDSHFIFGDVATAVIVERADQATDGWDILGTRLKTQFSNNIRNNFGFLNRADPEGVGKPDKLFVQEGRKVFREVVPMVSEMIVDHAADLGIDPTGLKRLWLHQANINMNEMIGRKVLGRDPAPGENVIILDEYANTSSAGSIIAFHKANDDFQTGDTGLICSFGAGYSAGTVFVRKR

SEQ ID NO: 20 - protein, 342 aa, Chloroflexus aggregans
MYDRKVARVSRERYAAVIGWGMAVPNRVVTNDDLAQRIDTSDEWIRTRTGIRERRVAGPGESTSTFATAAGREALEMAGVSPATIDTVIVATCTPDRPFPATACTVQANLQIPRATAFDLAAACSGFVYGLTVATSLIKSGVSRRLLLIGADIFTHYINWNDRNTCVLFGDGAGAVVLEATDEPLGLIASNLSADGNLEDLMAVDAGGTRMPLTAELLAEGRQYVYMNGREIFKHAVREMSESALHVVQAAGLTIDDIALVIPHQANVRIIDAVARRLELPPERVMINLDRYGNTSAASIPIALYEAAQQERIKAGDYVLMTAFGGGLTWGSGIVRWGRPSR

SEQ ID NO: 21 - protein, 327 aa, Lactobacillus hilgardii
MKFENFKILATASQVPTRVVDNDELSTMMDTSDDWIVQRTGIRRRHIAVDETTSSLCTSVAKQLLEKTGLKPSEIDLIIVATMSPDYLTPSVSAMVQGNLGADHAVAMDIDAACSGFVYGLNMVKQLLIAETPKNAILIGGEMLSKLIDWQDRSTAVLFGDGAGGVLLKNTPKAEGAFISENLKTLGKLGRYLTAGKTGAPTPFMEKKDEFSPFFQMNGRRVYRFAVNNVPESINQALAEASLTTDDIDHFVLHQANSRIVEKIAETLGVSMDKFPINIDEYGNTAAASEPILLDQLVTNGTIKRGDVVLLSGFGGGLTVGTMILKY

SEQ ID NO: 22 - protein, 327 aa, Streptomyces anulatus
MRMSDLGILGTGAYVPDRVVSNDDVGAAAGVDDAWIRRKTAIRERRWAAPGQATSDLAAAAGRAALRSAGITADQLSVIVVATSTPDRPQPPTAAYVQHGLGAAGAAAFDVNAVCSGSVFALAVAEGLLAGRGGHALVIGADLYSRILNPADRRTVVLFGDGAGALVLGPAAQGPRVRHLALHTFGELAGLIEVPAGGSRLPGDRAALEAGLQYFAMDGREVRRFVAEQLPRLTKQFLHEAGVVPDDIGHFVPHQANGVLLDAVTADLGLPRAASHRTLAHYGNTGAASIPITLDTAARAGAFRPGDLILLAGFGGGMSAGLALVEW

SEQ ID NO: 23 - protein, 320 aa, Clostridiales bacterium
MTTRIIGTGSYVPEQIVTNNDLAQIVETNDEWIRSRTGIGERRIATTESTSYMAANAAMRALEQSGVKPEEIDLILLGTSSPDYCFPNGACEVQGMIGAVNAACYDISAACTGFVYALNTAHAFISSGIYKTALVIGSDVLSKLIDWTDRGTCVLFGDGAGAVVVKADETGILGINMHSDGTKGNVLTCGSRTNGNFLLGKKPELGYMTMDGQEVFKFAVRKVPECIKQVLDDAGVAAAEVRYFVIHQANYRIIESIAKRLKVSVDCFPVNMEHYGNTSGASVPLLLDEINRKGMLESGDKIVFSGFGAGLTWGATLLEW

SEQ ID NO: 24 - protein, 324 aa, Bartonella grahamii
MIRSIIRGVGSALPKRSLSNDEIAKFVETSDSWIVQRTGIRQRYIASENETTVSLGVEAAQAALTNAGLTIKDIDCIILATSTPNRTFPASAVEIQCALGMSHGFAFDIQAVCSGFIFALTTGDSYLRCGAAKRILVIGSDTFSRILDWEDRTTCVLFGDGAGAAILEAQEIEGGIAFERGILSAKLRSNGAYIDKLYVDGGPSTTQTTGYLRMEGREVFKYAVGMITDVVDDCFAAAGMDSSQLDWFVPHQANKRIIEASAKKLGISLDKVVITVDQHGNTSAASVPLALTTAVCDGKIKEGDLIMLEAMGGGFTWGAILIRW

SEQ ID NO: 25 - protein, 324 aa, Clostridium botulinum
MYNVKIISTGKYIPDNVVTNDDMSKFVDTNDKWISERTGIKERRISTGENTSHMAVKAALAALEKSSVKATDLDLIIIATCTPDSFVPSTACIVQDKLGATKATCFDISAACTGFIYALGVASQFIKTGQVKNALVIGAETLSKILNWEDRSTCILFADGAGAAIIERSEEVGLISQYTGSDGTGGKALKCEALPVRNPYCKVDDKFKDTLSMEGREVFKFAVNAMIESINKVLENTEYTLDDIDYIVPHQANIRIIEFVSKKLGISQDKFYVNLHKYGNTSGASIPIALDEMNKKGMFKKGDNIILVGFGGGLTFGAHLIQWN

SEQ ID NO: 26 - protein, 312 aa, Vibrio cholerae
MYSKILGTGSYLPSQVRTNADLEKMVETSDEWIVARTGIRERRIAADNETVADMAFFAAQNAIDMAGIDKHDIDMIIVATTSASHTFPSAACQVQGKLGIKGCPAFDLAAACSGFMYALSIADQHVKSGMCKHVLVIGADALSKTCDPTDRSTIILFGDGAGAVVVGASNEPGILSTHIHADGEFGDLLSLEVPVRGGDSDKWLHMAGNEVFKVAVTQLSKLVVDTLKANNMHKSELDWLVPHQANYRIISATAKKLSMSLDQVVITLDRHGNTSAATVPTALDEAVRDGRIQRGQMLLLEAFGGGFTWGSA

SEQ ID NO: 27 - protein, 323 aa, Ruegeria sp.
MTRRAVIAGIGHYLPERIVENAEFEATLDTSDEWIRSRSGIERRHFAAEGETTSNMATKAAQNALADAGMTADDIDAIVVATSTADLTFPSAATMVQAQLGMTKGFAFDVQAVCAGFVYALSNANALVASGQADKVLVIGAETFSKIMDWTDRSTCVLFGDGAGALVLEAQEGAGTSDDRGILATDLNSDGRFKDLLYVDGGVSTQNTGHLRMQGNQVFRHAVEKLASTAHTSLERAGLGADDVDWIVPHQANIRIIQGTAKKMGLPMDKVVVTVQDHGNTSAASIPLALSVGKARGQIKQGDLIVTEAIGGGLAWGSVVLRW

SEQ ID NO: 28 - protein, 369 aa, Acinetobacter lwoffii
MGIRITGTGLFHPEHVITNEELVESLNAYVELFNHENADKIAAGEVEARRGSSADFIEKASGVQRRYVVEKSGILDPKRLRPNLRERADDEISLQAEWGVIAAKQAMENAGVTAEDIDIVILSCSNLQRAYPAVAIEIQTALGIKGYAYDMNVACSAATFGLKQAYDAIKAGARRVLLVNVEITSAHTDFRSRDCHFIFGDVATASIIENTDSKTGFEILDSELFTQFSNNIRNNFGFLNTSENADIDDKRFRQDGRKVFKEVCPLVAKMITAQLEKNQIEPTGVKRFWLHQANASMNELILKLVVGKENAKPGLVPIILNEFANTSSAGVIIALHRTAHEVEDGEYGVLCSFGAGYSVGSILVQKRVA

SEQ ID NO: 29 - protein, 332 aa, Propionibacterium acnes
MTAIKTRPVHGYSKFLSTGSARGSRVVTNEEMCTLIDSTPEWIEQRTGITERRWATSSETVASMGTTAARTALERSGLEASQIDAIIVATVSHHRPSPSLAAYIARELGLGDAAAFDLNGACAGFCYSTALADSMIRTGSANYVLVIGVEKLSEMTNLDDRSTAFLFSDGAGAAIISASDEPGIGPVVWGSRSDQLKTIELEDWPTASADPNKIHPLIRMEGRAVFKWAMTDVAKRAAEAVAEAGITPADLDVFIPHQANDRITDVVSRHLKLPESVTVCHDIADMGNTSAASVPIAIDRMLQRGQAHSGDLALIIGFGAGLVYAGQVIRLP

SEQ ID NO: 30 - protein, 333 aa, Streptomyces ghanaensis
MAKIKPSKGAPYARILGVGGYRPTRVVPNEVILETIDSSDEWIRSRSGIETRHWASPEETVAAMSVEASGKAIADAGIDAAQIGAVVVSTVSHFAQTPAIATEIADRLGTDRAAAFDISAGCAGFGYGLTLAKGMVVEGSAEYVLVIGVERLSDLTDLEDRATAFLFGDGAGAVVVGPSQEPAIGPTVWGSEGDKSETIKQTVPWTDYRDGTVEKFPAITQEGQAVFRWAVFEMAKVAQQALDAAGITADDLDVFIPHQANVRIIDSMVKTLKLPEHVTVARDIRTTGNTSAASIPLAMERLLATGEAKSGDTALVIGFGAGLVYAASVVTLP

SEQ ID NO: 31 - protein, 331 aa, Veillonella sp.
MTMMNKPVGIIGTGSFLPDNVVTNFDLEKMVDTNDQWIRERTGIEERRIAPEGMNTSYMATEAAKKAMQMANVTAEEIDMIIFATLTPDMIIPSAACVLQANLGAKNAAAYDLQAACSGFVYGLITAASYISSGIYKKVLVVGAEILSRRVNWNDRGTCILFGDGAGAAVVSEVPEGYGIKGIDMGADGTGGSALCIPAGGTAVVANDQRVEEGLTFIHMDGPEVYKFAVKTMGRTVLKSLERASMELNELDYFIPHQANIRIIDSAAKRLHLPMEKVFVNLHKYGNTSAASVAIALDEANREGRFKRGDNVAFAGFGAGLTWASLVLKWY

SEQ ID NO: 32 - protein, 373 aa, Pseudomonas aeruginosa
MHKAVISGTGLYTPPYSISNDELVESFNTFVRQYNDQHAEAIAKGELEALAESSSAFIEKASGIKSRFVMNKEGILDPQRMVPYLPERSNDEWSILCEMAVAAAREALQRAGRSAADIDGVIVACSNLQRAYPAIAVEVQAALGIQGYGYDMNVACSSATFGIQAATTAIQTGQARAILMVNPEICTGHLNFRDRDSHFIFGDACTAVIVERADLAVSKHQFDIVSTRLLTQFSNNIRNNFGFLNRADESGIGKRDKLFVQEGRKVFKDVCPMVAELIGEHLAANEIQVAEVKRFWLHQANLNMNLLITRKLLGRDAEAHEAPVILDSYANTSSAGSVIALHKHQDDLPSGAIGVLSSFGAGYSIGSVILRKH

SEQ ID NO: 33 - protein, 343 aa, Streptomyces sp.
MTAIGILGTGSYLPADTVSNRVVGERAGVTEDWILQKTGIRERRYAAEYEATSDLAVEAARSALDAAGISAEQLSWIVVATSTPDSPQPATACLVQHRIGAVNAAAFDVNSVCSGFVFGLVAAARMLPGQDGGVRGHALVIGADVYSRIIDREDRRTAVLFGDGAGAVVLGPVRSGYGVLGSYLASRGDQAELIRVEAGGSRLPASEKTVAEGLHHFRMNGRGVRDFVAAELPRAVGEVLDRHGLERSEVDHFVPHQANGVMLGETVPRLGLPRARTHLTVAEHGNTSAASIPLALDEAYRSGAFRDRDVVLLAGFGGGMSLGTVLVRWDEEAAPAPRKDSAA

SEQ ID NO: 34 - protein, 313 aa, Mycobacterium tuberculosis
MTEIATTSGARSVGLLSVGAYRPERVVTNDEICQHIDSSDEWIYTRTGIKTRRFAADDESAASMATEACRRALSNAGLSAADIDGVIVTTNTHFLQTPPAAPMVAASLGAKGILGFDLSAGCAGFGYALGAAADMIRGGGAATMLVVGTEKLSPTIDMYDRGNCFIFADGAAAVVVGETPFQGIGPTVAGSDGEQADAIRQDIDWITFAQNPSGPRPFVRLEGPAVFRWAAFKMGDVGRRAMDAAGVRPDQIDVFVPHQANSRINELLVKNLQLRPDAVVANDIEHTGNTSAASIPLAMAELLTTGAAKPGDL

SEQ ID NO: 35 - protein, 341 aa, Rothia dentocariosa
MTTLKQYENNRYSRILGYGASRGEVIVHNNDIVEAINSSDEWIKQRTGISTRHRASENQTVNDLAIAAAHDALANSHVTGEQIDAVIISTISHPYATPSLAVLVADAIGSRCPAYDISAACAGFCYGIAQADAMVRSGMAQNVLVIGVEKLSDFIDNTERSISFLLGDGAGAAVVSVSDEPGIAPTIWGSDGSRWGTVGMTHSLLDIRNRDFVVNPVQEDEKIWPTLRQDGPSVFRWAVWEMAKVAQQALESAGITPDELGALIPHQANARIIDQMAKTLKLPENVAIARDIADAGNTSAASVPLAAHRLLQEQPELSGKFALQIGFGAGLAYAAQVVVLP

SEQ ID NO: 36 - protein, 328 aa, Caldicellulosiruptor kristjanssonii
MKQNVKILSTGRFVPEKILSNYDLEKMVETSDEWITQRTGIKERRIVDGRTSTTDLAVQAARNAMQKAGISPDEIDLVIVATVTPEMFFPSTACLVQKELKLKNAFAFDISAACSGFIYGMAVATQFIQNGFCKTALVIGAEALSKITNWSDRSTCVLFGDGAGAAILTASSEEGILGFELGSDGENGLLLYCHAFGLSDLSYSQFKDMPNFRKIYMDGNEVYKFAVKIMPYAVEKVLEKVGLSSSDIDVFIPHQANIRIIESAAKRLKIPMEKVFVNLHKYGNTSAASIPIALDEAIEEGRIKKGDRIVLVGFGGGLTWASCAVKWI

SEQ ID NO: 37 - protein, 307 aa, Streptomyces sp.
MDNSELCATVASTPEWIETRSGIRARGFAAPDETLRFMGRAAAEKALARAGVLPDGIDLVLVASMSRLEQTPPLAVLLAEDLGARAAAGLDVSGACAGFCHALALASDAVRAGSARHVLVVGTERMTDLVERADRTVSVLFADGAGAAVVGPSARPGISPPARGAAGRYAGALRMDRGWDAFAADPSLGRPWMRMDGRRVFRWAMDEVTPRAAELLRESGIEPEALDAFVPHQANLRMIELMAERLGLPERTAVARDVVRAGNTSAASVPLALEALLDSGEVGSGDRALLVGFGAGLNYAAQVVELP

SEQ ID NO: 38 - protein, 331 aa, Thermoanaerobacter brockii
MCEKIAAGILGTGSYVPEKVLTNFDLEKMVDTSDEWITTRTGIKERRIADPSQATSDLATEAAKKALEDAKVDPSEIDMIIVATVTPDMNFPSTACIVQANLGAANAAAFDISVGCSGFIYGLAIAQQFVETGMYNKILVIGAETLSKIINWKDRNTCVLFGDGAGAVVVGRVESGYGILSSYLGADGTGGKHLYMPAGGSRMPASEETVKKNLHTIFMEGQEVFKFAVKVMDSATIEALNRCGLKPEDIDMLIPHQANTRIIEAARKRLKLSNDKVYINLDKYGNTSAASVAIALDEAYRKGLIKKGDVILTVAFGAGLTWASSVIRWSK

SEQ ID NO: 39 - protein, 322 aa, Thermus scotoductus
MSGILALGAYAPERVMKNEEFEAYLDTSDEWIVTRTGIRERRIAAEDEYTSDLAFKAVEDLLGRHPGALEGVDGVIVATNTPDALFPDTAALVQARFGIQGFAYDLLAGCPGWLYALAQAHAMVEAGLARKVLVVGAEALSKIVDWNDRATAVLFGDAGGAAVVGKVSKGFGFRSFVLGADGTGAKELYHACVAPRLPDGTSMRNRLYMNGREVFKFAVRVMNTATLEAIEKAGLTPEDIKVFVPHQANLRIIDAARERLGLPWERVVVNVDRYGNTSTASIPLALKEAVDEGRIREGDHVLLVSFGAGLTWAAAVITWGGA

SEQ ID NO: 40 - protein, 326 aa, Geobacter sp.
MIRAEILGTGGFVPARVVPNAHFNYLVDDADQWIHSRTGIRERRFASAEEATSDLATNAALLALENGDVDPLEIDCIIVSTSTPDMILPATACMVQKNIGAAKAFAFDMNAVCSSFIYGMEVADNLIRSGKYRKVLLIGADTYSKILDFDDKGSAPLFGDGAGAVILGAGLSGKGILQSVMHSDGNGWELIQVPSSGSRKPVTAESIAAKENTFKMAGKSVFTFATDVIPRIISDLAERGGIRAEDIDHIIPHQANVRIIDFISRKTGIPKEKFLLNLDRYGNTAAASVGLALDENRRNGVIKSGELVLMMGFGGGLSWGGVLLKA

SEQ ID NO: 41 - protein, 316 aa, Actinobacillus ureae
MYSKILATGSYLPAQIRTNADLEKMVDTTDEWIFTRSGMKERRIAAADETVATMGAQAAKKALEMAKIDHNEIDLIVVGTTTNSHAYPSAACQIQGMLEIKDAIAFDVAAACTGFVYALSVADQFVRTGKVKKALVIGSDLNSRALDETDRSTVVLFGDGAGAVILEASEEQGIISTHLHSSSDSEYMLALPAQKRGNEKSGFIQMQGNATFKLAVGQLSSVVEETLEANNLQKSDLDWLVPHQANIRIIAATAKKLEMDMSQVVLTVEKYGNNSAATVPVALDEAVRDGRIQRGQLLLLEAFGGGWTWGSALVRF

SEQ ID NO: 42 - protein, 345 aa, Rhodococcus equi
MPAPIATATPAAHAALLGLGVYRPRRVVPNSEIVDRIDSSDEWIRTRSGITARGWAEPDETIVSMSVAAARDALAAAGLVAEQIDAVVLATSSQMVLGPSAGAVVATELGMQDTAAFDISAGCAGFCYALGNAASLVRAGQARHVLVIGVERLSDLLDPTDRTCAFIFADGAGAVVVGPSDSEGIGPVAWGSDGSQTKAIKQDKDFMQYFAEVAAAEAAGGSTERPYIRMDGQAVFRWAITFLEKACRDALEKAGVTADDLDAFVPHQANSRITDALIRTLGLPDSVAVARDIAESGNTSAASIPMAMEQLLRSGEARPGDTALLLGFGAGLAYAGQVVQLPAIS

SEQ ID NO: 43 - protein, 325 aa, Xanthomonas vesicatoria
MSKRIYSRIAGTGSYLPEKVLTNDDMSKIVDTSDEWIFSRTGIRERHIVADDQTTSDLAYFASLKAMEAAGVTADEIDLIVIGTTTPDLIFPSTACLLQARLGNVGCGAMDVNAACSGFVYALSVADKFVRSGDAKTVLVVGAETLTRIVDWTDRTTCVLFGDGAGAVILKADEETGILSTHLHADGSKKELLWDPVGVSVGFGEGKNGGGALLMKGNDVFKYAVKALDSVVDETLAANGYDKHDLDWLIPHQANLRIIEATAKRLDLPMEQVVVTVDRHGNTSSASVPLALDEAVRSGRVQRGQLLLLEAFGGGFTWGSALLRY

SEQ ID NO: 44 - protein, 332 aa, Clostridium papyrosolvens
MIKSTKSVGIIGTGSFVPEKVLTNNDLEKMVDTSDEWIIKRTGISERRILDHDTPNYTMGIEAANRALEDAGLKAEDIDLLILSTEAPDYMSPSMSCIIQGAIGAVNAIAFDLNAACTGFIYSLSVARQFIANGVYRNALVIGCEGLSKIVDWKDRNTCILFGDASGAVVLGEVDEGYGILDSFLGSNGAEGMNITIPNLYLSEEEKAKRVNEKYNTLWMDGKEVFKFAVKAMSSATMHVLDNLNMDIKELDFIFPHQANTRIIDGAIKKLGITDDKIHYIINKYGNISSASIPVAMDEAKRDGKLKKGDNMVLVAFGGGLTWGSMAVKWSK

SEQ ID NO: 45 - protein, 334 aa, Cellulomonas fimi
MTRPTLTQATGPAHSRILGIGGVRGERVVPNDDLVGPIDSSDEWIRQRTGIVTRRRAGEGTDVLDLAEGAARAAIENAGLTGADIDAVILSTVTYFHQTPAGAAIIADRIGATPAAAYDISAACAGYCYGIGQADALVRAGAARHVLVIGAEKMSEFVDPTDRSISFLLGDGAGAVVIGPSDTPGIGPTVWGSDGAQAQAIRQTHSWLATRDEGAGWPTLRQEGQSVFKWAVWQMAPVAQKALDAAGVTADQIDAFVPHQANMRIIDQMIKQLKLPETVVVGRDIADTGNTSAASIPLATERLLREGQVSSGALALQIGFGAGLVYAAQVVVLP

SEQ ID NO: 46 - protein, 369 aa, Pseudomonas putida
MISGTGLYTPAQSISNEELVASFNTWSQQFNEDNAAAIERGEVEAAPLSDAAFIEKASGIKSRFVMDKAGILDPQRMKPRLPERSNDEPSVLCEMAVAAARQALERAGRTAADVDGVIVACSNLQRPYPAIAIEVQQALGIQGFAFDMNVACSSATFGIQTAANSVALGQARAVLMVNPEVCTGHLNFRDRDSHFIFGDAATAVLLERADKATSAHQFDIVSSKLWTEFSNNIRNNFGFLNRAAEEGEGAADKLFIQEGRKVFREVCPKVAELIGEHLQENGLQPSDVKRFWLHQANLSMNHLIVKKLLGREVAEEDAPVILDRYANTSSAGSVIAFHLYQDDLAKGSLGVLSSFGAGYSIGSVVLRKR

SEQ ID NO: 47 - protein, 373 aa, Pseudomonas stutzeri
MYNVVISGTGLYTPASSISNDELVESFNTYVHRFNSENAAAIEAGEVQPLAESSSAFIEKASGIKSRYVTDKAGILDPERMVPRIPERSNDEWSILCEMSVKAAEEALARAGKTAADIDGVIVACSNLQRAYPAIAIEVQAALGIKGFGFDMNVACSSATFGIQNAVNSIKLGQARAILMVNPEICTGHMNFRDRDSHFIFGDACTAVVIEREDLATSAHQWEVLSTKLVTEFSNNIRNNFGFLNRTAEEYMSNPDKLFIQEGRKVFKEVCPMVAELIGEHLSENGIAVESVKRFWLHQANLNMNHLIVRKLLGRDATEEEAPVILDTYANTSSAGSVIAFHKHQDDLPSGSLGVLSSFGAGYSIGSVILRKR

SEQ ID NO: 48 - protein, 320 aa, Neisseria macacae
MQYAKILGTGSYLPANRVSNDDLAKKVDTSDEWITTRTGIKFRHIADEGEKTSDLAAEASRRALVAAGVTADEIDLIIVATATPDMQFPSTATIVQQKLGIANGCPAFDVQAVCAGFMYALSTANAYIKSGMAKKALVIGAETFSRIVDWNDRTTCVLFGDGAGAVVLGASDEAGIIHSKLKADGNYLDLLNVPGQIANGQVCGSPYITMDGPGVFKFAVKMLAKIADEVISEAGYTPDQIDWLVPHQANKRIIDSTAKHLGLDMEKVILTVQEHGNTSAASIPLALDVGIQNGQIKRGQNLLLEGIGGGFAWGAVLVKY

SEQ ID NO: 49 - protein, 325 aa, Stenotrophomonas maltophilia
MSKRIYSRIAGTGSYLPEKVLTNADLEKMVETSDEWIQSRTGIRERHIAAEGETTSDLGYNAALRALEAAGIDASQLDMIVVGTTTPDLIFPSTACLIQAKLGVAGCPAFDVNAACSGFVFALGVADKFIRSGDCKHVLVIGTETLTRMVDWNDRTTCVLFGDGAGAVVLKADEETGILSTHLHADGSKKELLWNPVGVSSGFKDGANGGGTINMKGNDVFKYAVKALDSVVDETLAANGLDKSDLDWLIPHQANLRIIEATAKRLDMSMDQVVVTVDKHGNTSSGSVPLALDAAVRSGRVERGQLLLLEAFGGGFTWGSALLRY

SEQ ID NO: 50 - protein, 346 aa, Rhodothermus marinus
MPYAAITAVGHFLPEDRLTNADLEKMVDTSDEWIRTRTGIRERRILRDPNKATSYMATEAARECLRKRGMDPEDVELIIVATVTPDMFFPATACLVQANLGARNAWGFDLSAACSGFLFALSTAARFIESGKHKRVMVIGADKMSTITDYTDRKNCILFGDAAAAVLLEPDPECGVIDSVEHCDGNNWELLCMLGGGSLNPPTHETVDRKMHYLHQEGRAVFKLAVEGMAQVAVEIMERNNLTADDVRYLVPHQANLRIIDATARRMGLSPDKVMVNIDRYGNTTAATIPLCLYDWERQLRRGDNLILAAFGGGFTWGAIYLKWAYDGDKVAAAAEATAETSTENA

SEQ ID NO: 51 - protein, 323 aa, Gluconacetobacter oboediens
MTAKRSLLSGFGGYLPERIVTNDELASRLDTSDEWIRGRTGIGQRHIAGENDTAVSMAAQAARRALDYAGAAPDDVDAIIVATSTPDQAFPSTAVRVQAELGMTSGFGFDLAAACSGFIYALSMADSLIRSGQARSALVIGSEVYSRILDWSDRGTCVLFGDGAGAAFLTAAGPDDGDAGILSTHLHSDGQYGDLLYVDGATGQHDRPAHLRMQGRDVFRHAVGKLSASVDEALAANNLSHADVNWLVPHQANLRIIDGVARKLALPAERVVVTVDRHANTSAASIPLALNEAVRDGRIRKGDLVLMEALGGGLTWGSALVRL

SEQ ID NO: 52 - protein, 373 aa, Halomonas sp.
MTHVVITGTGLYTPEHAIDNAALVAAFNAWVDGENEQHAEAIERGEREPLANSSSEFIEKASGIKSRYVLDASGILDPQRMRPKLPQRSNDEPSLQCEMATEAAHQALAAAQVDAADIELVIVACSNLERAYPAVAVEVQQTLGTSGYGFDMNVACSSATFALETAANAIASGSVNRALVVNPEICSAHLNFRDRDSHFIFGDACTAVVLENSAVAVADEQFEILGTRLVTKFSNAIRNNAGFLNRVTDSDPMALDKLFVQEGRRVFKEVCPMVAKLITDHLASLELNGSDLKRMWLHQANRHMNDLIARKVLGYDPSETQAPIILDRYANTSSAGSIIAFHLHREQFNQGDIGVICSFGAGYSAGSVVIRRV

SEQ ID NO: 53 - protein, 313 aa, Staphylococcus simiae
MNVGIKGFGAYAPENIIDNAYFEQFLETSDEWISKMTGIKERHWADEDQDTSDLAYNASVKAIEDAGIKPEDIDMIIVATATGDMPFPSVANILQERLGTGKVASMDQLAACSGFMYSMITAKQYIQSGDYHNILVVGADKLSKITDLTDRSTAVLFGDGAGAVIIGEVSEGRGIISYEMGSDGSGGKYLYLDKETGKLKMNGREVFKFAVRIMGDASTRVVEKANLTSDDIDLFIPHQANIRIMESARERLGISKDKMSVSVDKYGNTSAASIPLSINQELQNGKLKDDDTIVLVGFGGGLTWGAMTIKWGK

SEQ ID NO: 54 - protein, 328 aa, Fusobacterium necrophorum
MKSVGIKGLSSYVPERIMTNFEFEKIIDTSDEWIRTRTGIEERRFASPEQATSDLCYEATQKLLATMKMDPQEIDFIMVCTCTPDYPVPSTACVLQSKLNLLGVPAVDINAACSGFMYGLAMATSMVQTGLYKNVLVIGAETLSRIMDMQDRNTCVLFGDGAAAAIIGEVEEGSGILATHLGAEGEDEGILQIPGGGSRYPSTLESVHTKKQFVQMKGQNVYKFAVHALPEATLAALKKAKVEASQVARFFPHQANLRIIEAAAKRMNVSLDKFHVNLHKVGNTSAASVGLALADALEKGMVKKGDYIALTGFGAGLTYGSVVMKWAY

SEQ ID NO: 55 - protein, 307 aa, Unknown
  Description of Unknown: Uncultured Aquificae bacterium polypeptide
MGTTLTGIGYYLPPKVLTNFDLEKMVDTSDDWITTRTGIKERRIADNENVTQMAYMASLEALESANIQPEDIDLIILATLTPELKFPSTACLLQAKLGAKRAYAFDISAACSGFIYGLELADAYIKSGKAKKILLVGAERLSEIVNWQDRSTCVLFGDGAGAVIISEGDGEVLSSKMLSDGELWEILYAPKCGYINMKGKELFKLAVRSMEEVCRYVLESAGISIEDVSIMIPHQANIRIMEALAEKLGMPKEKVYSNIHKYGNTSAASIPIAMYEAYKEGKLRRGDIVMLTAMGGGLTWGAALLRF

SEQ ID NO: 56 - protein, 340 aa, Saccharomonospora cyanea
MSTQDARGVAVLAGLGGWLPPRVVDNDELSRRLDTSDEWIRTRTGIAKRHVVHTGLSTVDMAVEAGRRALESAGPYGENVDAVVLATSTPDHVCPASAPQVAAELGLSGAAAFDVNAVCSGFVYALATASGLISGGVAKRVLLVGADAFTTLLDPDDRTTVPIFGDGAGAVVLREGSADELGAVGPFDLHSDGELAELLIVPAGGSRRKKSENASDHFLKMQGPAVFRHATARMASSSRAVLEKAGWTTSDVDRFVGHQANVRILTATAKNLGLPADSLVVNIGHTGNTSAASIPLAMVDAAVDGMLQPGDRVLVTAFGAGLTWGSTVLRWPELACAPLP

SEQ ID NO: 57 - protein, 326 aa, Saccharomonospora azurea
MTRPTLTLAQGAKASRVLGVGSTQPDRVVTNDELSQHMDTSDQWIRDRVGIIERRFAGEDERLVDMAVTAGAKALADAGVAPSEVDTVIVPNCTMPAPIPNAAAQVADRIGVKAAGAFDLNAACAGFCYGLGVASDLVRAGSAKKVLVIGAEKLTDVVDPTDRSTAIIFADGAGAALVGPSDEPGIGPVAWGSAGDLVDVIYMRDNRYIFQEGQPVFRWATTQIAPVAMRAVELAGLELSDIDVLIPHQANLRIVEAIAKRLRAKGARDDMVVADDIRYSGNTSSASIPMALDHMRAAGTVKPGDVVLTVGFGAGLSYAGQVLICP

SEQ ID NO: 58 - protein, 326 aa, Bradyrhizobium sp.
MTQIRSVVLGCGSYLPEQVVTNAQLAARIDTSDEWIVQRTGIRERHIAAEGEFTSHLAIKAAQAALTDAGLDAQSIDLIVLATSTPDNTFPATAVAVQHGLGINHGAAFDLQAVCSGFVFALATADNFLRTGAFKRALVIGAETFSRILDWNDRGTCVLFGDGAGAVVLEAQEQPGNAATDRGVVTTHLRSDGRHKAKLFVDGGPSSTQTVGHLRMEGREVFKHAVGMITDVIVDAFEATGLNADSIDWFVPHQANKRIIDASAHKLHIAPEKVVLTVDRHGNTSAASIPLALSVARRDGRIKRGDAVLMEAMGGGFTWGSALVRW

SEQ ID NO: 59 - protein, 333 aa, Arcobacter butzleri
MIYAAFRSIGAYIPPKIMSNADFEKIIDTSDEWITKRTGIKERRIANEGEASSDLGARAGELAIERAGISKEEIDLVICATVTPDFLCMPSTACLIAAKLGLPNVMAFDVSAACTGFVYALNVAKAFIESGMKKNVLIVGAEKYSAILDYTDRTTCFLFGDGAGAAIISATNDKNESIIDINCSSDGNYEDLIKTPGGGSKNPCSQEVLENKMACIKMKGNETFKLAVKTLTSDVKTMLEKHNLTNEDINHFIPHQANYRIIKAVGEALDLSDEKTVVTVDKYGNTSAASIPMAMNYAFEQGKIKAGDTILFDAFGGGLTWGSALFKFAPIKR

SEQ ID NO: 60 - protein, 335 aa, Chlamydophila psittaci
MCVKKTRKASIWATGSYLPEKILSNSDLEQMVDTSDEWIVTRTGIKERRIAAANEYTSIMGAKAAERAIQKAGLTKDQIECIIFSTSAPDYIFPSSAALAQAYLGIKDIPAFDCMAACTGYLYGLSVAKAYVESGMYNNVLLIAADKLSSFVNYKDRNTCVLFGDGGAACIIGESRPGALEITNVNLGADGSVADLLSLPAGGSRVPASQETLEAGKHFISMEGKEVFKHAVRRMESAAKTCIAGAGIEESDIDWLVPHQANERIIDAIAKRFEIDEGKVFKTLCKYGNTAASSVCIALDELLQSHTIHSGEYLLLVAFGGGLSWGAVVLQQVES

SEQ ID NO: 61 - protein, 373 aa, Marinobacter adhaerens
MIKAVISGTGLYTPPATISNDELVEAFNQYVELFNAENADAIASGDVTPLQPSSSSFIEKASGIKRRHVIDKDGILDPNRMKPYIPDRSNEEPSVQCDMAVTACREALEQAGKSAEDVDAVIVACSNLQRAYPAVSIEVQEALGIDGFAYDMNVACSSATFGLQAAVNSVENGSARAVLVVSPEICSGHLNFRDRDSHFIFGDACTAILVEREEDTREGQGFEILGTSLKTKFSNNIRNNFGFLNRADESGVGKPDKLFVQQGRKVFKEVSPLVAETIQKQLQSLSLAPDDLRRMWLHQANLNMNQLIARKVLGRDATEEEAPVILDEYANTSSAGSIIAFHKNKDDLVSGDLGVICSFGAGYSIGSVVVRRR

SEQ ID NO: 62 - protein, 316 aa, Haemophilus influenzae
MNSRILSTGSYLPSHIRTNADLEKMVDTSDEWIVTRSGIRERRIAAADETVATMGFEAAKNAIEAAQINPQDIELIIVATTSHSHAYPSAACQVQGLLNIDDAISFDLAAACTGFVYALSVADQFIRAGKVKKALVIGSDLNSRKLDETDRSTVVLFGDGAGAVILEASEQEGIISTHLHASADKNNALVLAQPERGIEKSGYIEMQGNETFKLAVRELSNVVEETLSANNLDKKDLDWLVPHQANLRIITATAKKLEMDMSQVVVTLDKYANNSAATVPVALDEAIRDGRIQRGQLLLLEAFGGGWTWGSALVRF

SEQ ID NO: 63 - protein, 373 aa, Ralstonia solanacearum
MHDVVISGTGLWVAPEVITNEELVASFNAYARHYNEANATAIAAGTLAAVAESSVEFIEKASGIRQRYVIDKAGVLDPARMRPRLAPRGDDALSLQAEIGVAAAREALAAAGRDAGDIDMLICSAANMQRPYPAMGIEIQNALGADGYAFDMNVACSSATFGLEQAINAVRTGSARVALMVNPEITSGHLAWKDRDCHFIFGDVCTAVVVERADDARAPDQWQVLGTRMATRFSNSIRNNAGFLSRSEDRDPDDRDQLFRQEGRKVFKEVCPMAAEHIAGHLQSLGHAPADVRRFWLHQANLGMNQLIGKRLLGRDASADEAPVILDEFANTASAGSIIAFHRHRADLQPGDLGLICSFGAGYSIGSVAVRKR

SEQ ID NO: 64 - protein, 329 aa, Paenibacillus peoriae
MNKLRPVGIIGTGKYVPEKILTNKDLEAIVETSDEWIVSRTGIQERHIAAPEQATSDLAYEAAIKALKSAGMTAEDLDLIIVATVTPDMAFPSTACILQDKLGAKGAAAFDLSAACSGFVYGLATATSFIKTGIYNNALIIGADCLSRITDYTDRNTCVLFGDGAGAVVIGEVSEGRGFQSFDLGAEGAGGSLLNLAAGGSRLPASADTLENKQHYIYMNGREVFKFAVRVMGTATVDVLEKAGLTKDDIDLFVPHQANIRIIQSAMQRLDLPEEKVVINVNKYANTSAASIPLALVEAAEEGRMKEGDRVLMVGFGGGLTWGASVLVW

SEQ ID NO: 65 - protein, 307 aa, Frankia sp.
MLGLGVYRPARVVTNDEIAQRVETSDAWIQSRTGIATRRIADEEETTVAMGAAAAEKALAAAGLTADTIDLVIGATCTSPSQIPGAGPQIAHRIGADQAGAFDINGACAGFSYAVSTAADMVRAGSVRHVLVVATERLSDYTDWDDRSTCILLADGAGATVIGAAETDEIGPAVWGHDGSRPEAIRVPGYGDNMFRMEGQAVFRWAISLVPTVRQICERAGVAPDELAGIVPHQANLRIVEALATGIGATNAAVARDVVDSGNTSAASIPLGLARLLDAGEIRRGDPVLLFGFGAGLTYCGQVVRCP

SEQ ID NO: 66 - protein, 372 aa, Alishewanella aestuarii
MQQVVISGSGLFTPQHIISNDELVVSFNQYVDQFNTEHAAQIAAGELAALEYSSSEFIEKASGIKARHVLYKDGILDPKVMHPVFRKRGEDELPEMVEMAVQAATQALAQANKTAADIDLIICAASNMQRPYPALSVELQQALGAGGYAFDMNVACSSATFAISNAVNAIRGGSAKVVLVVNPEFASPQVDYRSRDSHFIFGDVCTATIIEAESSCTSSQAFRILGMRLKTTFSNNIRCDIGYTEHCFSEQDPKAPFFKQQGRKVFKELLPIVAEVILDEMAAQQVTADDLKRLWLHQANINMNIFAAKKILGRDPLPEEAPLVLDTYANTASAGSIIAFHKYQQGLQSGDKAILCSFGAGYSVGCLVLEKC

SEQ ID NO: 67 - protein, 312 aa, Bacillus vallismortis
MKAGILGVGRYIPEKVLTNHDLEKMVETSDEWIRTRTGIEERRIAADDVYSSHMAVAAAKKALEQAEVAAEDLDMILVATVTPDQSFPTVSCMIQEELGAKKACAMDISAACAGFMYGVVTGKQFIESGTYKHVLVVGVEKLSSITDWEDRNTAVLFGDGAGAAVVGPVSDDRGILSFELGADGTGGQHLYLNEKGHTIMNGREVFKFAVRQMGESCVNVIEKAGLSKEDVDFLIPHQANIRIMEAARERLELPVEKMSKTVHKYGNTSAASIPISLVEELEAGKIKDGDVVVMVGFGGGLTWGAIAIRWGR

SEQ ID NO: 68 - protein, 373 aa, Pseudomonas sp.
MHNVVISGTGLYTPANSISNEELVQSFNAYVAQFNADNADAIARGEVEALTESSAAFIEKASGIKSRFVMDKDGILDPQRMAPRLPERSNDEWSVLCQMAIGAAEQALQRAGKTAADIDGVIVACSNLQRAYPAIAIEVQEALGIQGFGFDMNVACSSATFGIQAAANSVQLGQARAVLMVNPEVCTGHLNFRDRDSHFIFGDAATAVIIERADLATSKYQFDVVSTKLLTKFSNNIRNNFGFLNRAAEEGIGAKDKLFVQEGRKVFKEVCPMVAELIGAHLEENQLNVGDVKRFWLHQANLSMNHLIVRKLLGREATEAEAPVILDTYANTSSAGSVIAFHKNQDDLAAGSLAVLSSFGAGYSIGSVILRKR

SEQ ID NO: 69 - protein, 342 aa, Brevibacillus sp.
MRQMDKKRSVGILATGSYTPDRVLSNFDLEKMVETTDEWIVSRTGIRERRICSAEQASSDLAYEAAKKALERANISAEQLDMIIVATVTPDMMFPSTACILQEKLGAKRAAALDVSAACTGFLYGITTAAQFIANGLYKYVLVVGVETLSKITNYKDRNTCVLFGDGAGAAVIGEVREGFGFQSFELGADGAGGELLCLPAGGSRIPASSESVENNLHYLSMAGGEVFKFAVRVMNSATEAVLSKAGVERENIDLLVPHQANKRIIDSAVQRFGLSEDKVAINLDRYGNMSSASIPVALDEAIAAGRVKEGDNVILVGFGGGLTWGATLLKWSTTPAEGSGQ

SEQ ID NO: 70 - protein, 374 aa, Phaeobacter gallaeciensis
MFTPAITGTGVFTPSQTITNAELVAAFNAYADKTNAENAKAIAAGEMEPLAHSSEEFILKASGIEQRYVMDKSGVLDPEVMHPLLRQRGDDEPSIMAEMALDAAKKALAQAGKTAADVDTVICAASNMERAYPALAIEIQDLLGIKGFAFDMNVACSSATFGIQAAADMVRSGSIRSALVVNPEICSGHLEWRDRDCHFIFGDVATATLIERSEDATGAYFEILSTRCATSFSNNIRNNNGYLRRSRPDGVEDRRDMQFMQNGRKVFKEVLPMVSQHIAEHMEAEGVSNTDLKRLWLHQANKTMNDFIGKKVLGRTPEAGEQPNILQDYANTSSAGSIIAFSKYSDDLSAGDLGLICSFGAGYSVGSVILRRVA

SEQ ID NO: 71 - protein, 326 aa, Geobacter sulfurreducens
MMRARIVGTGSAVPSKVLTNFDLEKMVDTSDEWVTTRTGIKERRIAVDGEYTSTFATLAAERALEMAGVKASDLDLLIVATITPDFPFPATACVVQSNLKATKAAAYDISAACSGFIYALAQASNAIRSGSARKALVIGAEVLSRIIDWTDRNTCLLFGDGAGAVVLEACDDGHGVLSTHLHSDGSYWELLYQPGCGNRNPAVQKTLDDRRIYLMMQGNEVFKLAVRAMEDAALEALDANGLTPADISLFIPHQANRRIIDAIGKRLGLPGEKVYVNLDRFGNTSAASIPLALDEANRSGRIKPNDVVVFDAFGGGLTWGSALVRW

SEQ ID NO: 72 - protein, 334 aa, Selenomonas sp.
MPKISAGILGTGYYVPERVLTNFDLEKMVQTNDAWIVERTGIHERRIAADGEPVSVLAQRAAEMALADAGVDAADLDLIIMATLTSDRIIPSTACVLQDRLGAKHAAAFDLSAACSGFVYAASIAAQFIESGVYRHVLVIGGETLSKVVDWEDRNTCILFGDGAGAAVFGPVEDGYGIRAFDLGSDGSGGDALDIPSSGSLCPVTPETIEQRLNFVHMDGKAVFRFATKVMGRTVETSLERAGMQREDLDYLVPHQANIRIIQAAAKRLDMPMDKVIINIHRYGNMSAASIPVALAEAAHAQQFKKGDNIALAGFGAGLTWASCIMKWAKEENG

SEQ ID NO: 73 - protein, 323 aa, Sphingomonas sp.
MIRSVLIGTGSALPRNAVSNAELAERVDTSDEWIVERTGISNRHIAEADETTSSLATEAGRKAIEAAGIDAESIDLIVLATATPDQTFPASATIVQSRLGCRAGGIAFDVAAVCSGFLYAVGVADSMLRTGMARRALVIGAETFSRILDWEDRTTCVLFGDGAGAVVLEAQEQVGETPRGILATRLHADGAHNQLLFVDGGPSTTGTVGKLRMKGREVFRHAVVNLAEVLREVIEEAGLSTSDIDWLVPHQANARILDATAKKLSLPPEKVVMTVGQHANTSAASVPLALDVAVRDGRIKQGDLVMLEAMGGGFTWGASLIRI

SEQ ID NO: 74 - protein, 374 aa, Alteromonas macleodii
MSQQVVISGVGVWHPKDSITNEELVDSYNAYVDAFNEENKAQIESGDVAAMPYSSAEFIEKASGIKSRYIYQKEGALDITRMKPKIAPRADDELSHQAEIAVEAAKLALASANVTADEIDAVIVSCAYTQRAYPAIAIEVQEALNIEGFGFDMLVACSAATFGMHRAYEMLSAKNATRVLVINPELVSPQINYADRDSHFIFGDVATATVLELAETAKSEHVYDVLSTKALTKFSNNIRSNFGYMTRAEDVDPYGPDKLFHQAGRKVFKEVCPLAAAHIEAHLASHDITPEGVKRWWLHQANINMNTLICKRLLGRDADRTEAPIVLDEYANTASAGSVIAFGLNHEDLVAGDVGVLCSFGAGYSIGSLVIRKR

SEQ ID NO: 75 - protein, 341 aa, Leptospirillum ferriphilum
MTPTMLNRSIILGTGSFAPANVLTNEDISRKVETSDLWIRERTGIRERRIASSGESTSDLALEAGRNALRNAALSPADLDGIIVATATPDLTFPSTACLVQARLGIPGTFAFDVNAVCSGFMYALKIADSMIRSGQCETLLVIGAEVMSRFVDWSDRSTCILFGDGAGAVVLGKSGSPQTGGVGTVTLHADGRYWDLIHVPGGGSRSPVETEKPPGNACTIRMKGSETFRMAVRSLEESVREVLKEEGIGVNELDWVVPHQANIRILEALSERLGIPLGHFVVNIDRYGNTSAASIPMALDEAVQDKRIQPGHRILLTAFGSGVTWGSGLVHWTQKAGGDR

SEQ ID NO: 76 - protein, 319 aa, Glaciecola polaris
MNSRIIGTGSYYPSEVRTNADLSLMVDTSDEWITDRTGIKERRIIGADETAASMGVEASKKALEAAGIDAKSLDMIVCATTSGRYALPSTACEIQKALDIDGIPAFDVAAACAGYCYALSVADQYIKSGMAKRILVVGTDCLSRMISPEDRTMVILFGDAAGATIIEASEEPGILSTHIHAAGSYGDLLAIGNPTRGDEASIHENWGSMKGNEVFRVAVTKLSEVVEETLAANNMQKSDLDWLVPHQANFRIIKATAKKLNMSLDQVVLTLERYGNTSAATVPTALDEAIRDGRIKRGQNLLLEAFGGGFAWASALVRY

SEQ ID NO: 77 - protein, 319 aa, Aeromonas aquariorum
MHSKILGTGSYLPHSVRTNADLEQMVETSDEWIVERTGIRERRIAGADETVATLSHQAALRALEAAGLTAADLDMIVLATTSAENAFPAAACELQGLLGVQGIPAFDVAAACAGFTYALSIADQFVKSGAARHVLVVGADVLSRMCDPEDRGTIILFGDGAGAVVIGASDTPGILSTHLHADGRYGELLKLPQPRRGMPGAELEAYMYMKGNDVFKVAVTRLSEIVTETLAAAGIEPSELDWLVPHQANFRIISATAKKLGMGLDKVVLTLDKHGNTSAASVPIAFDEGVRDGRIKPGQLVLLEAFGGGFAWGSALVRL

SEQ ID NO: 78 - protein, 316 aa, Escherichia coli
YTKIIGTGSYLPEQVRTNADLEKMVDTSDEWIVTRTGIRERHIAAPNETVSTMGFEAATRAIEMAGIEKDQIGLIVVATTSATHAFPSAACQIQSMLGIKGCPAFDVAAACAGFTYALSVADQYVKSGAVKYALVVGSDVLARTCDPTDRGTIIIFGDGAGAAVLAASEEPGIISTHLHADGSYGELLTLPNADRVNPENSIHLTMAGNEVFKVAVTELAHIVDETLAANNLDRSQLDWLVPHQANLRIISATAKKLGMSMDNVVVTLDRHGNTSAASVPCALDEAVRDGRIKPGQLVLLEAFGGGFTWGSALVRF

SEQ ID NO: 79 - protein, 287 aa, Listeria monocytogenes
MDTSDEWIRTRTGIEERRIARDDEYTHDLAYEAAKVAIKNAGLTPDDIDLFIVATVTQEATFPSVANIIQDRLGAKNAAGMDVEAACAGFTFGVVTAAQFIKTGAYKNIVVVGADKLSKITNWDDRTTAVLFGDGAGAVVMGPVSDDHGLLSFDLGSDGSGGKYLNLDENKKIYMNGREVFRFAVRQMGEASLRVLERAGLEKEDLDLLIPHQANIRIMEASRERLNLPEEKLMKTVHKYGNTSSSSIALALVDAVEEGRIKDNDNVLLVGFGGGLTWGALIIRWGK

SEQ ID NO: 80 - protein, 221 aa, Salmonella enterica
MLGIKGCPAFDVAAACAGFTYALSIADQYVKSGAVKHALVVGSDVLARTCDPGDRGTIIIFGDGAGAAVLSASEEPGIISTHLHADGRYGELLTLPNADRVNPDNPIYLTMAGNEVFKVAVTELAHIVDETLAANNLDRSELDWLVPHQANLRIISATAKKLGMSMDNVVVTLDRHGNTSAASVPCALDEAVRDGRIKAGQLVLLEAFGGGFTWGSALIRF

SEQ ID NO: 81 - protein, 335 aa, Mycobacterium avium
MKQIAATSGPTNIGLLSVGSYRPQRVVTNDELCQNIDSSDEWIYSRTGIKTRRFAARDESTASMATEAGREAIAKAGLEASDIDCVVVATSTHFLQTPACGPAVAAALGATGVPAFDISAGCAGFGYALGVAADMVRGGTAGKVLVLGSEKLSPTVDMTDRSNCFIFADGAAGVVVGETPTQGIGPTVWGSDGTQATAIRQDIDWMDYLDRPTGPRPFLRLEGSAVFRWAAFEMGKVGQQAMDAAGVRPDEIDVFLPHQANSRINEILAKSLELRPDAVIANDIEHTGNTSAASIPLAMAEVLATGAAKAGDLALLIGYGAGLSYAAQVVRLPPG

SEQ ID NO: 82 - protein, 220 aa, Yersinia pestis
MLGIKDAASFDLAAACAGFTYALSVADQYVKSGAVKHAIVIGSDVLSRALDPEDRGTIILFGDGAGAVVLGASEQPGIMSTHLHADGRYGELLALPYPDRQQDQPAYVTMAGNEVFKVAVTELAHIVDETLQANNLDRTALDWLVPHQANLRIISATAKKLGMGMDKVVITLDRHGNTSAASVPSAFDEAVRDGRIQRGQLVLLEAFGGGFTWGSALVRF

SEQ ID NO: 83 - protein, 392 aa, Rhodopirellula baltica
MIETSSNVTANDLAAKSVNEESSAESTAVPTEAVSAVMPGNATTRGRMGNLKGVRIAGTGSYVPERIVTNEDLAALGCDSDWIVRRTGILQRRHAEPGQATSDLCYEAALRCLENANVSVDEIDLILVATITPDHPTPSTACHLQRRLGAVAPAMDIGAACAGFMYALVTGAQFVSNGNARNVLVIGADLMSRTVDPEDKKTYPLFGDAAGAALLVPSTQDECQSTECNGSAADSTSQTDGLLAYQLGSEGCGGEMLCIPAGGSRTPITTDGEDSASRYLQMDGRGVFKWAVRVFDESAKDVLRAANVSSDQLSLVVLHQANQRIIDSAVSDLNVPPEKVFVNLDKYGNTSGASIPLALDEAARAGRLKEGDLVLLCGFGAGLAWGTALLRW

SEQ ID NO: 84 - protein, 355 aa, Ralstonia solanacearum
MPRCRFPPPLRPPTPHKGSAPGHPIPTPHMTRYARIIGTGSYLPPKRVTNHELAAQLAEKGIETSDEWIVTRSGIRARHYAEPDVTCSDLAVKAAERAIEAAGIDRAEIDMILVATSTPDFVFPSAACLVQQKLGLSNHCAAFDLQAVCSGFVYALATADKFIRAGGCRNVLVIGAEVFSRILDFNDRTTCVLFGDGAGAVVLQASDEPGILSTALHADGSHADILCVPGNVAAGAIKGSAFLYMDGQAVFKLAVNVLDKVAREALGLANVEASQIDWLIPHQANIRIMQGTAKKLGLPNERMVVTVDEHGNTSAASIPLALDAAVRDGRIRKGHHVLLEGVGGGFTWGAALLRF

SEQ ID NO: 85 - protein, 328 aa, Fusobacterium nucleatum
MQSIGIKGIGYYVPENVFTNFDFEKIIDTSDEWIRTRTGIVERRFASKDQATSDLAREAALKAIENAKIKKEDVDMIILATTTPDYIAQGAACIVQNKLGLTSIPCFDLNAACTGFIYGLEVAYSLVKSGLYKNVLVIGAETLSRIIDMQNRNTCVLFGDGAAAAIVGQVEEGYGFLGLSIGAEGEDDMILKVPAGGSKKPNDEETIKNRENFVIMKGQDVFKFAVSTLPKVTLDALEKAKLDVNDLSMVFPHQANLRIIESAAKRMKFPLEKFYMNLSRYGNTSSASVGIALGEAVEKGLVKKGDNIALTGFGGGLTYGSAIIKWAY

SEQ ID NO: 86 - protein, 331 aa, Desulfitobacterium hafniense
MVSVGIVGTGSYVPDKVLTNFDLEQMVDTNDQWIVSRTGIKERHIAEPETPVSELCYQAAVRALEDAKLPPEELDLVIVATITPDFVFPATACLVAERLGAKKAAGFDLQAACTGFLYGVATAAQFIATGIYKNALVIGGETLSKILNWEDRGTCILFGDGAGAAVLQPVEEGYGFLGYDLGMDGAGGSLLTMPGGGSMHPASAETVAKKMHTIQMAGSEVFKFAVRIMGETALKALDKAGLGIGDVDCLIPHQANTRIVDAAVKRLGIDAKKVVVNLDRYGNMSAASIPVALDEAARSGRLNYGDIMVMVGFGGGLTWGAAVVKWSKRGV

SEQ ID NO: 87 - protein, 373 aa, Aeromonas hydrophila
MTSIVISGSGLYTPPFAVSNEALVAAFNQYVDLYNEENASAIDAGQLPAKQHSSSEFIEKASGIKSRYLVSKEGVLDPDIMQPLLAERPDDKPSIMVEMAVAAAEQALIAAGREPGEIDLVIVAASNMPRPYPALSIELQHYLGASGMAFDMNVACSSATFGIKTAADMLAAGSARLALVVNPEICSGHLNFRDRDSHFIFGDACTAVLLEREADCQVANPWQLVASKLVTQYSNNIRNNFGFLNRLSPRTRYGDDKLFRQQGRKVFKEVLPLVCDQIAGQLDEQGWAADSLSRLWLHQANLTMNQFIARKLLGHDASQQEAPVILDSYGNTSSAGSIIAFHLYNRDLPAGARGVLCSFGAGYSIGSLLLRRL

SEQ ID NO: 88 - protein, 373 aa, Pseudomonas syringae
MHNVVISGTGLFTPANSISNEELVQSFNAYVAQFNSDNAAAIERGDVQALSESSAAFIEKASGIKSRFVMDKEGILDPQRMKPNLPERSNDEWSILCEMGVAAATQALQRAGKTAADIDGVIVACSNLQRAYPAISIEIQQALGVAGYGFDMNVACSSATFGIQAACNSVQLGQARALLVISPEICTAHLNFRDRDSHFIFGDGATAVVVERADLATSPYQFDIVSTRLLTQFSNNIRNNFGFLNRTSDEGQSAPDKLFVQEGRKVFREVCPMVAELVAAHLQDNGINITDVKRFWLHQANLSMNHLIVKKLLGRDASVEEAPVILDTYGNTSSAGSVIAFHTYQDDLPQGALAVLSSFGAGYSIGSVILRKR

SEQ ID NO: 89 - protein, 339 aa, Rhodococcus opacus
MGKQIATVAGGRQSALLGLGVYRPERVVTNDEICELIDSNDEWIQSRSGIRNRRFAAEDENVVTMSIAAGRKAIEASGIDPEQIGCVIVATSTYLLLTPPAAAVVADALGTNGPGAFDLGGGCAGFCTALTVASDLVRGGSVDYALVVGVEKMSITTDPTDRSTRFIFGDGAGAVVVGKSDVAGIGPVEWGSDGAQADAIVQDLDWYEYITTPGATRPYIKMAGTAVFRWAAFEMGKVALRAVEKAGMSVDDLDAFVPHQANSRITEVIARSMKLPENVPVSDDIAESGNTSAASVPLAMEEMLQSGATKPGDTALLLAFGAGLSYAAQVVTMPVLAKD

SEQ ID NO: 90 - protein, 329 aa, Bordetella bronchiseptica
MMEKAMKYAKIAGSGGYLPERVVTNDDLAAELATRQISTSDEWIVERTGIRQRHLAERGVTTSQLATEAARRAMDDAGVQPDEIDMIIVATSTPDYVFPSTACLVQANLGAKGGAAFDVQAVCSGFVYAMTTADSFIRAGRARCALVIGAEVFSRILDWNDRGTCVLFGDGAGAVVLKAADEPGILAAHLHADGSQTKILCAAGNVAYGDVTGDPFLRMDGQAVFKQAVTVLDRSARDVCAEAGVEVDDIDWLIPHQANVRILNFLARKLRVPTERVVITVDQHANTSAASVPLALDVARRDGRVKPGQLVLMQGVGGGFTWGSVLARM

SEQ ID NO: 91 - protein, 356 aa, Gordonia aichiensis
MSVIAANTGHQNVAMLGIGAYRPQRLVSNDEVCEVLDSSDEWIFERSGVRNRRWISGDESARSMAAAAAERAIENSGIAKEKIGALILATNSWKTKIPHGGPIVAYDIGLNGIPAYDIAAGCGGFGYALGVAADTVRAGSAEYVLVVGVETMSVVMEPTDRNTAFIFGDGAGAVVVGPSEANGISPTVWGSDGENAEAIGQNYDIPEYMDRAQEYQHKDPETDPVGRMVVTMQGPRVFRWAAITLPKALTSVIERSGISADDIEVFVPHQANARINELMKKNLGFPDDMPMANDIENTGNTSAASIPLAMEEMLATGKAKGGQTALLLGFGAGLSYAGAVVTLPPAPKVSSFDDLG

SEQ ID NO: 92 - protein, 314 aa, Micromonospora lupini
MTGSRIVSMGHYQPSRVVTNDDIAKLVDTNDEWIRDRVGIVSRRIADGETVADMAAAAAGKALANSGLSASDIDLVVVATCSSIDRSPNVACRVAAKLGIAAPGAFDVNTACSGFAYALGTVDHAVRAGASRNALVIGAEKLSDFTDWTDRSTCIIFGDGAGAAVVTATADDEPAGIGPVVWGSVPEKSDAVRIEGWRPYIQQEGQSVFRWATTAIAPLALQACERAGVDPSELAAFVPHQANARIIDGIAKRLNIPDAIIAKDIVESGNTSAASVPLALSKLVERREVPSGAPVLLFGFGGGLTYAGQVVRCP

SEQ ID NO: 93 - protein, 362 aa, Mycobacterium liflandii
MEHRPECCCGCALAQMPSPPEESVPLPPTVGILGTAAFVPPRVVTNNQAGASAGIDDAWIFARTGIRTRRWADPEQATSDLAVQAAEQALANTAINAGQLGAIIVSTSTPDQPQPPTAAFVQNALHANSAYAFDTNAVCSGFLFAINTAHALAQRDSIHVLVIGADVYSRILDPTDRKTVCLFGDGAGAVVVGPTTASSRHLRIVDTELHTFTQHINLIGVPGGGSRQPLTTATLDAGQHYFHMDGRGVRDFVTTTVPEQVRKFLARHHLAVEDIDHVVMHQANGRMLDEIYSLLDLRNATCHQTIDRFGNTGSASIPITLHHAYPELHGNILCIGFGGGMAAGITLLAAASGSAGDVGAHK

SEQ ID NO: 94 - protein, 353 aa, Arthrobacter sp.
MSVPTLKQAPIQEHTRILGLGAYRPDVIVTNEDVCQWIDSSDEWIRQRTGIVTRHRAKADVSVIDMAEGAAREAMEKAGIEASELGAVIVSTVTHPYATPSAAASLADRLGATPAPAFDISAACAGYCYGIAQGDALVRSGTAKYVLVVGAEKLSDVIDNRERTISFLLGDGAGAVVIGPSETPGIAPSVWGSDGSKWDAIGMTRSMLDVRDLGLAARQSDSTGDLALLEEAQELYPTLRQDGQTVFRWAVWEMAKVAQQALEAAGVEAEDLVAFIPHQANMRIIDEMVKKLKLPETVTVARDIADAGNTSAASIPLATHRLLQENPELSGGLALQIGFGAGLVFGAQVVVLP

SEQ ID NO: 95 - protein, 338 aa, Gordonia paraffinivorans
MAVIADTTGIKNIGMLGIGAYRPERVVTNEEICQHIDSSDEWIYTRTGIKTRRFARRDESVMEMAVNAGRKAIANALLHGSDIDAVILATNTHLLLTPAGATKVATELGANGVPAFDVTVGCAGFGYGMALASDMIRGGSATHVLVIGAEQLSVTLDMTDRTNCFIFGDGAGAVVVGPTEEQELGPVVWGSDGSQFNAIRQDLDWVTFLDSDRKQRPYLRLEGTAVFRWAAFEMGKVAHRALEAAKIGAEDLDVFVPHQANARINELLARSLKLREDAVVANDIEYTGNTSAASIPLAMEDLLSTGKAQPGQTALLLGFGAGLSYASQVVKLPPVPFE

SEQ ID NO: 96 - protein, 373 aa, Mesorhizobium sp.
MHRVIISGLGVEIPEPSITNEELVASFNAWVDTENVRRQASGEAPLAKSDSAFIVHASGVQTRHVIEREGILDPTRMAPRIPARPDDALSLQAEFGIASARKALDHAGLKPSDIDLVICSSSHQQRPYPAIAIEMQEALGTKGAGFDMGLGCSSAAAALHMAVNLVRSGAHKRVLVTTPEIITGHLNFRDRQTHFIFGDASVSMIVEGLAKGDKRPGRFEVLDTRIWTQMSNNIRTNLGYHTRTAQDDPYMINLEGNLIKQVGNKVFKEVTVAGHKFIVEFLAEHGLTPEAIRRFWLHQANARMNAMILKLSFGHEVGHDRAPMVLERLGNTAGAGAIIALSENHADMKPGDFGLLCAFGAGYSIGGALLRML

SEQ ID NO: 97 - protein, 322 aa, Marinobacter nanhaiticus
MPYARIIGTGSYLPEKALTNKDMEKMVDTTDQWIRERTGIERRHIAAEGETTVDLAEQASLKAIEAAGIDVQDIDLIVFATSTPDKIFPSCACILQARLGIQGCPAFDIQAVCSGFVYALSTADKFIKTGASKKALVIGSEVFSRIVNWEDRGTCVLFGDGAGAVVLEANEETGILSTHIHADGQYEDLLHVPCGISDDFERVKAGQAFIEMKGNEVFKVAVNTLGKIVDETLEYNQMQKSDIDWLVPHQANLRIIAATAKKLNMSMDQVVVTVNEHGNTSAASIPLALDVAVRDGRIKRNEVLLLEAFGGGFTWGSALLRY

SEQ ID NO: 98 - protein, 368 aa, Acinetobacter sp.
MGIRITGTGLFHPTESISNEELVESLNAYVEQFNQENAEQIAAGEIEALRGSSPEFIEKASGIQRRYVVEKSGILDPKRLRPRLQERSNDELSLQAEWGVIAAKQAMENAGVTAEDIDVVILACSNMQRAYPAVAIEIQSALGIQGYAYDMNVACSAATFGLKQAYDAVKCGARRVLLLNVEITSGHLDYRTRDAHFIFGDVATASIIEETETKSGYEILDIHLFTQFSNNIRNNFGFLNRSEDAVVDDKLFRQDGRKVFKEVCPLVAKIITAQLEKLELTPEQVKRFWLHQANANMNELILKLVVGKEADLERAPIILDEFANTSSAGVIIAMHRTGEQVNNGEYAVISSFGAGYSVGSIIVQKHIA

SEQ ID NO: 99 - protein, 343 aa, Rhodothermus marinus
MLPEQSLTTPLPATTTAAPARRAAVLGVGAALPAHREPSAETERRLGLPPGWIARRTGIRERPLVGPDEATSDLAVRAGAAALAQAELSPERIGLLLLATSTPDHLLPPTAPVVAHRLGLKHAGAIDLAGACSGFLYALALADGYVRLQRTCVLVIGANVLSRRTNPDDPKTSALFADGAGAVVLGPSEGSRGIVACWLGADGSCWDDLYIPAGGSRRPLTPERVARGEHLMYMKDGRALFRRAATGMAEAGRRVLQQAGLDLDDVAWWIPHQANLRLIEEARRQLGMPEARTVNLVDRIGNSSAATIPLALALEAHRFAPGDLLLLTAVGAGLLSAAVLIQW

SEQ ID NO: 100 - protein, 343 aa, Streptomyces davawensis
MTAPTAVLAGLGSALPPRVVTNHDLTARMDTSDEWIRTRTGIAERRIVDPGGATSDLAIEAGRRALDSAGGPDVGAVVVATATPDHPCPATGPTVAAGLGLGTVPAFDVGAVCSGFLYALATGAGLIAASVADSVLVVGADAFTTIVDPYDRNTAPIFADGAGAVVLRAGRADEPGALRRTELASDGMQADLIRVAAGGSRQRSHHSAALREDQYLTMRGGEVFKNAVLRMTEASRTVLDRTGWSTAEVDLLVGHQANVRILHAVAEQLGIGQERAYVNIGHTGNTAAASIPLALDDAHGEGRLRAGDKVLLTAFGAGTTWGAITLTWPEGLQYRGAAGSAAA

SEQ ID NO: 101 - protein, 331 aa, Chlamydophila pecorum
MDKIKKAAILATGSYLPEKILSNADLEKMVDTSDEWIVTRTGIKERRIASDNEYTSDMGAKAAEKAIRASGLSKDLIDCIVFATSAPDYIFPSSGALAQAYLGIKEVPAFDCLAACTGFLYGLSIAKAYVESGTYNHVLLIAADKLSSFVNYQDRNTCVLFGDGGAACIVGRSRPGALEINQVCLGADGALGDLLSLPAGGSRNPATEATLKEGRHYISMEGKEVFKHAVRRMEAASKASIAVAGIQEEQVGWLVPHQANERIIDAIAKRFNISEAKVFKSLYKYGNTAASSLGIALDELLNTETVLPHEYLLLTAFGGGLSWGSVVLEHV

SEQ ID NO: 102 - protein, 331 aa, Clostridium ultunense
MNSLYSVGITGIGSYVPEKVITNYDLCEIVDTSNEWIVERTGIQERRIVDQSLSTSDIGTIAANKALEDSNTNPKEIDLIIVATATPDMAFPSTACIVQKNIQAINAAAFDISAGCSGFIYGLSIGFNFIKAGTYRKVLVIGGETLSKIVNWEDRNTCVLFGDGAGACILERCEEGFGFLTFDLGSDGNNGHLLIQPAGGSRLPASYETVSNRLHTIKMDGREVFKFAVRIIEKSSKEVLRKANIPLEQIDLLIPHQANMRIIQSAIKKLQLEENKVYINLDKYGNMSSASIPVALDEAYKKEFFSKGDIVLLVAFGAGLTWGATLLRWNK

SEQ ID NO: 103 - protein, 333 aa, Corallococcus coralloides
MARTHIIGTGSYAPTQVLTNQDLERLVETSDAWIRERTGIQERRQAAPDEATSDLAVNAARNALEMAGVAPGDLDLIVVGTVTADMPMPSCAALVQSKLGAKRAFAFDVSAACAGGLYALSVADQFVRSGQVKRALVVGADLLTRAVDWTDRNTCVLFGDGAGALVLGAEQDADEDAMAPRGILSTHLRTDGDLANLLCIPAGGSRTPVTADNVDANLHKLKMNGKEVFRFAVRALVESTQASLGAHGMDTTQVDHVIAHQANLRILEAVMERLEIPKEKCWLNLHKYGNTSSASLPMSLDEAQRAGRLKRGDVIAMMAIGAGMAWGSAVVRW

SEQ ID NO: 104 - protein, 334 aa, Desmospora sp.
MRIMGSVGIIGTGAYLPEKVLTNADLEKMVDTNDEWIVSRTGIRERRIAADDQASSDLAVEAGRRALESAGIEAKDLDLIIVATVTPDMAFPATACLVQDRLGAEKAATFDLSAACTGFLYGISVASQFISNGMYRHALVIGVDCLSKITDFTDRNTCVLFGDGAGAAVLGPVEEGKGFLSFELGGDGSGGHLLKQPAGGSRIPASGKSVEDRLHFISMNGREVFKFAVRVLGSSAEEALRKAGMTKEDVDFLIPHQANTRIIDTAVQRLGLSRDKVVVNLDRYGNMSSASIPVALDEAVQRGKIKKDDTLVLVGFGGGMTWGASVMKWTMETK

SEQ ID NO: 105 - protein, 329 aa, Paenibacillus peoriae; identical to SEQ ID NO: 64

SEQ ID NO: 106 - protein, 330 aa, Pelosinus fermentans
MNKKCVGIIGLGSYVPQRIMTNKDLEERMDTSDQWIVERTGIHERRVAAENESTSDLAAKAGQKALEDAKISPAEIDLIIVATASPDMVFPATACVVQENIKAVNAAAFDISAVCSGFLYAMITGSQFIKAGTYRKVLVIGAETLSRFTDWSDRNTGMLFGDGAGAAVLGETPEGYGILGVDLGADGGGAELLKIPAGGSRHPATMETILQKQHFIYMNGNEVFKFAVKVMGETTLKALKNANLTASDITYLVPHQANIRIIQSAAKRLGIPMEKVVVNINKYGNTSAASIPIALDEAVKSGAIKSGDIVALAGFGGGLTWASSIMKWCK

SEQ ID NO: 107 - protein, 331 aa, Candidatus Solibacter
MPKAKISALGCYTPPRVLTNQDLEKLVDTNDQWIMERTGIRERHIAAPEMATSDMAIEAARCALLQRGIDACEIDAIILCTVTPDHLFPSTACLVQNAIGAKGAWGFDLIAACSGFLYGLTTGAHFVMAGTHKKVLVIGSDTMSRIIDYTDRATCVLFGDGAGAMLIEATDEADDGTGFIDFLGEIDGSGGEFLRMPAGGSRRPASHETVDQRMHYVHQEGSQVFKYASRKMYEVCRDLLERNHFKVEDVGLMIPHQANKRIIKAAGDRLGIAPERVMINIERYGNTTAGTLPLATRDAISEGRLKKGDLVLFAAVGAGYTVGASLWRWAF

SEQ ID NO: 108 - protein, 337 aa, Desulfotomaculum nigrificans
MSSNLVQAGIIGVGSYVPERILTNKDLEKMVDTSDEWITSRTGIKERRIADPEESTSELAVKAARRALAHAGVKPEELDLIILATCTKDMPFPASACLVQDQLGAVNAGAFDIEAGCTGFVYALTVGSQFVATGSMKRVLVIGADNLSKVTNWEDRNTCVLFGDGAGAVVLGPVAPGEGILASKLAAEGAGWKYLSMPAGGSRMPASPLTVEKKLHYIHMQGREVFRYAVKVMEEEAANIVKAAGLALSDIDLLIPHQANIRIIEHAAKKLKLSMDKVVVNVDRYGNTSTASIPLALDEAVKSGRVKAGDNIVMVAFGAGLTSGAIVLKWSLGEGKE

SEQ ID NO: 109 - protein, 323 aa, Saccharomonospora glauca
MSTGILGAAGYLPPRVIDNDQVGAWVDRDPDWILERTGIKERHYAAPEVSTSDMACLAVEKLYASCPEKRASVGAVILGTSTPDHNFPSTAAIVQGRMGLGRAFAFDLSAACSGYLFSFVTAHSLLSANPALEEVLVIGADTISKVLYQSDRKTVTVFGDGAAATRVGRVPDGYGLLTHTLITDGCHADYVGQPAGGSRRPLDATTVNARERYMVMHGRKVREYFEEVVPKLIHEVVEQAGVSLDDIDHFVFHQANPQMLADCINAMGIDPAKCPVPGVLSGNTGAASIPLVLSELRAERGDLVVMAAIGSGMTAGAAVLRWY

SEQ ID NO: 110 - protein, 335 aa, Corallococcus coralloides
MNQGGVFPLPFKIAGLGRYVPADVVLSSDLEKKYDLPPGWCVEKQGIRERRWVKDETASFMGAEAAKEAVRDAGLKLEDIDLIINASGSPEQAVPDGGPLVQRELGLGRSGVPSITVNASCLSFFVALDVAANYLNMRRYKRILIVSSDISSVALDFRKPENFTLFGDAAAAAVVTLPEPGEKSCIHASQVRTYGYGAEFSMVPGGGSRRHPNGKNTTPEDNYLHMNGAELLKIGFEYLPRFNEALWKQCPDITIKDCRYVIPHQPSRVVLDYLSLTYPDDKLVRIIDRFANCIGASMPMALYEAVKVGGLRRGERGVLTGTGSGVSFVGMVFTY

SEQ ID NO: 111 - protein, 336 aa, Legionella pneumophila
MNFFRCEKPIYIKGPFVALPERVMSNQDVLNWMNSTQNPAVIGFSTGIKNRHWVNEDQACSDLAVRAAEHLFMEKPREKHKVNQVILATISGDYPSPPSSPLVQYRLGLQNAGAFDIGAACAGFVVGLHTSAALAQTNDGSVLLIASEIRSKFLNKNNFATSVLFGDGAAACCVSQDKEEADFRFIASALFADGEVYDAVSTPAGGSRLPAAVCNDNEQFYITIKESTALFVKAVHGMADSAKDFLKELNLTISDIQWLVPHQGNKNLVLSVAKQLGFPEEKTIKTVEETGNTSGSSVGIALDRLRSDGKIKSGEKVLLVAAGGGGIAACSLLEVI

SEQ ID NO: 112 - protein, 330 aa, Streptomyces avermitilis
MTNEHLARRLDTDDAWIRTRTGIRRRHAVDPGQATSDLAVEAGRRALVCAATASVDAVVVATTTPDHSCPATAPAVAARLGLTGAAAFDISAVCTGFVYGLASAAGLIAAGVAERVLLIGADTYSTIVDPLDRANAIIFGDGAGAVVLRAGHPDEPGAVGHFDLGSDGAHEDLIMVAAGGSRQRSRPGEPSRQDRHFGMRGKEVYRHAVTRMAESARATLSRAGWKTDDVDHFVPHQANLRILHSVADDLGLPRERCVTHVESVGNTGAASIPLALADAAAGQTLRPGDRVLLTAFGGGLTWGSCLLTWPTLPAPAPPYDPHAQGERTTS

SEQ ID NO: 113 - protein, 350 aa, Verrucosispora maris
MALSSHVEYESTTRTAVIAGLGAYVPDQVVKNEEIAARLGVTTDWIRDRTGIEQRFVLNPEGATSDLAVEAARRALDSCGNPDIDFLILATCTPDHLFPSTAPSVASRLGFKGIAAFDLNAACSGFVYALSVSTGMLATGAYRTGLVIGADAISSILNHDDEITGPIFGDGGGAVVVRAGHLGETGSVSVQQLGSDGDLLDIMKTPGGGSRQRAAGVPVDIDSSYFTMSGRAVYKHAINRMSTVSRSVLERLGWTPDDVDWLIAHQANRRILTATAEEIGIAPERAVINVDRVANTSAASIPLAMVDAVESGALTAGDKVLLAAFGGGATWAAAGLTWPELTLAPTQTVR

SEQ ID NO: 114 - protein, 392 aa, Rhodopirellula baltica
MIETSSNVTANDLAAKSVNEESSAESTAVPTEAVSAVMPGNATTRGRMGNLKGVRIAGTGSYVPERIVTNEDLAALGCDSDWIVRRTGILQRRHAEPGQATSDLCYEAALRCLENANVSVDEIDLILVATITPDHPTPSTACHLQRRLGAVAPAMDIGAACAGFMYALVTGAQFVSNGNARNVLVIGADLMSRTVDPEDKKTYPLFGDAAGAALLVPSTQDECQSTECNGSAADSTIQTDGLLAYQLGSEGCGGEMLCIPAGGSRTPITTDGEDSASRYLQMDGRGVFKWAVRVFDESAKDVLRAANVSSDQLSLVVLHQANQRIIDSAVSDLNVPPEKVFVNLDKYGNTSGASIPLALDEAARAGRLKEGDLVLLCGFGAGLAWGTALFRW

SEQ ID NO: 115 - protein, 327 aa, Candidatus Methylomirabilis
MYGSRIAGTGASVPDRVLTNAELEQMVSTSDEWIVTRTGISERRIASDDQATSDLAEGAARQALEASGVDPHDLDLILVNTVTPDMFFPSTACVLQERLGASRAAAFDLMAACAGFVYGLSVADAYLRAGVMRNILVIGADTLSKVVDWSDRGTCVLFGDGAGAVVVQRTTADPAILSTHLYSDGSKGRQLIIPGGGSRQPASQKVIDEKLVTIRMPNGNEVFKTAVRSMEEAAIAALKANGAEVSDVDLFISHQANARIIYAVAERLDLPRERIYMNIDRYGNTSAASIPIAMDEAVRAGRLKRGDLLLLTAFGGGFTWGSALIRW

SEQ ID NO: 116 - protein, 418 aa, Thermaerobacter marianensis
MVAAVRGVTIAGIGGCVPPAVVTNDDLAQVVETDDEWIRTRTGIRQRRVADPGTATSDLAEVAARRALEEAGVRPDQVDLIIVATVTPDMPFPSTACLLQDRLGATRAAGFDLEAACSGFVYALAAGAQFIAAGLYDTVLVVGAETLSKIIDWSDRRTCVLLGDGAGAAVLRPAAPGEGILGLYLGADGSGGDLLKQPAGGSRLPASPETVARGLHFVQMNGREVFKFAVKTMGDAAQAALAQAGLTFDDVDLYVPHQANFRIIESSARRFDLPLERVVVNIDRYGNTSAASIPVALDEALSTGRIRAGQTVLLVAFGGGLTWGAAVVRWGYDRPAPRPLEMPGQEPRYGLPEWIREQAARGRARAGEPAQGEPAAAASEATAPAALAVPRAALDPAAVTAASPGSEGRPAWGGGGTR

SEQ ID NO: 117 - protein, 326 aa, Caldisericum exile
MKVGVLGLGSYIPEKVVTNHDLEKFLDTSDEWIRTRTGIVERRIANENEATSDLASIAAKRALEDANLKPEDIDLIIVGTNSPDMLYPATACLVQEKIGASGKCAAFDLQAGCPGFIYATVVGSQFVKSGAYKHVLVIGAEVITRMMDPTDRGTYVLFGDGAGAVVLGEVEDNRGIVDFELYADGSIAEHLTLPAGGSRKPFSEEVLKERSYFTKMNGGEVFKFSVREISRISKKLLDKTGTKLEDIDWFIPHQANLRIIQAGAEKLGIPMEKVVVTIDKFGNSSAASIPVSLDTIRKEGKLKRGDLVLMVSFGAGMTSGAILMRW

SEQ ID NO: 118 - protein, 332 aa, Indibacter alkaliphilus
MKKTRAVITGVQGWVPEYVLTNRELETMVDTNDEWITTRTGIKERRILKGENQGTSVIGINAVKGLLEKTNTKAEDIDLIICATVTPDMPFPATANIIADGVGAKNSYSYDISAACSGFLYALTIGSQFIETGMHKKVIIVGADKMSSIIDYQDRATCIIFGDGGGAVLLEPTQEKVGIMDSLLHADGSGAPFLHMKAGGSRKPASLETIAAREHFAFQEGSTVFKFAVTNMAEVSARIMERNNLASEDIAWLVPHQANKRIIDATANRMGVGPDKVMLNIEKYGNTTAGTLPLCLWDYESQLKKGDNIILAAFGGGFTWGSIYLKWGYDPK

SEQ ID NO: 119 - protein, 331 aa, Candidatus Amoebophilus
MRTAIRASITGVHGYVPEYILTNEKLEKMVDTNDEWITTRTGIKERRILEGTNQGTSVLGIPAVRGLLEKTNTDPREIDLLICATITPDMITPATANIIAHAVGATNAFSYDLQAACSGFLYALITGVQFIETGKYKKVVVVGADKMSSIVNYEDRNSCILFGDGAGAVLLEPNSQGYGIIDSILKGDGNGEQYLHQKAGGSRRPPSAETIAAKEHYVYQEGRAVYRFAVEKMAEVVLEIMKKNNLHHEDIKFLVPHQANKRILDAVAQRAGIKEEQVMITIQEFGNTTGATIPLCLWRYESQLQPGDKLIITTFGGGFTWGAAYLTWAYK

SEQ ID NO: 120 - protein, 348 aa, Flavobacterium sp.
MSAVITAIGGYVPSSILTNKKISETVDTSEEWIIKRTGIRERRIADDDTATSDLAAAAIENLIENYNVDREEIEALLVATATPDHILAPTASIVCDKSGLTNAFGIDMNAACSGFLYALEMGANMIESGRYKKLIIVGADKMSSIVDYEDRNTCILFGDGAGAILLEKSESDAGLMKTILKTDGSGVSSLAVPAGGSRNPTSMQSLLHRTHYLKQDGAFVFKRAVAAMSQVSQDALAKNELEADQIDWVVPHQANLRIITAVGESLGIDFEKVKVNIDRYGNTTSATVPLCLWDFKDDFKEGQNVLITTFGAGFSWGATCLKWGVMRERKSAETITATTKAEAVLVEH

SEQ ID NO: 121-123 - skipped (3 entries)

SEQ ID NO: 124 - protein, 329 aa, Escherichia coli
MKLAVYSTKQYDKKYLQQVNESFGFELEFFDFLLTEKTAKTANGCEAVCIFVNDDGSRPVLEELKKHGVKYIALRCAGFNNVDLDAAKELGLKVVRVPAYDPEAVAEHAIGMMMTLNRRIHRAYQRTRDANFSLEGLTGFTMYGKTAGVIGTGKIGVAMLRILKGFGMRLLAFDPYPSAAALELGVEYVDLPTLFSESDVISLHCPLTPENYHLLNEAAFEQMKNGVMIVNTSRGALIDSQAAIEALKNQKIGSLGMDVYENERDLFFEDKSNDVIQDDVFRRLSACHNVLFTGHQAFLTAEALTSISQTTLQNLSNLEKGETCPNELV

SEQ ID NO: 125 - protein, 760 aa, Escherichia coli
MSELNEKLATAWEGFTKGDWQNEVNVRDFIQKNYTPYEGDESFLAGATEATTTLWDKVMEGVKLENRTHAPVDFDTAVASTITSHDAGYINKQLEKIVGLQTEAPLKRALIPFGGIKMIEGSCKAYNRELDPMIKKIFTEYRKTHNQGVFDVYTPDILRCRKSGVLTGLPDAYGRGRIIGDYRRVALYGIDYLMKDKLAQFTSLQADLENGVNLEQTIRLREEIAEQHRALGQMKEMAAKYGYDISGPATNAQEAIQWTYFGYLAAVKSQNGAAMSFGRTSTFLDVYIERDLKAGKITEQEAQEMVDHLVMKLRMVRFLRTPEYDELFSGDPIWATESIGGMGLDGRTLVTKNSFRFLNTLYTMGPSPEPNMTILWSEKLPLNFKKFAAKVSIDTSSLQYENDDLMRPDFNNDDYAIACCVSPMIVGKQMQFFGARANLAKTMLYAINGGVDEKLKMQVGPKSEPIKGDVLNYDEVMERMDHFMDWLAKQYITALNIIHYMHDKYSYEASLMALHDRDVIRTMACGIAGLSVAADSLSAIKYAKVKPIRDEDGLAIDFEIEGEYPQFGNNDPRVDDLAVDLVERFMKKIQKLHTYRDAIPTQSVLTITSNVVYGKKTGNTPDGRRAGAPFGPGANPMHGRDQKGAVASLTSVAKLPFAYAKDGISYTFSIVPNALGKDDEVRKTNLAGLMDGYFHHEASIEGGQHLNVNVMNREMLLDAMENPEKYPQLTIRVSGYAVRFNSLTKEQQQDVITRTFTQSM

SEQ ID NO: 126 - protein, 152 aa, Escherichia coli [sequence omitted]

SEQ ID NO: 127 - protein, 572 aa, Escherichia coli
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATMHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKADRKFLDKALEDYRDARKGLDDLAKPSEKAIHPQYLAQQISHFAADDAIFTCDVGTPTVWAARYLKMNGKRRLLGSFNHGSMANAMPQALGAQATEPERQVVAMCGDGGFSMLMGDFLSVVQMKLPVKIVVFNNSVLGFVAMEMKAGGYLTDGTELHDTNFARIAEACGITGIRVEKASEVDEALQRAFSIDGPVLVDVVVAKEELAIPPQIKLEQAKGFSLYMLRAIISGRGDEVIELAKTNWLR

SEQ ID NO: 128 - protein, 714 aa, Escherichia coli
MSRIIMLIPTGTSVGLTSVSLGVIRAMERKGVRLSVFKPIAQPRTGGDAPDQTTTIVRANSSTTTAAEPLKMSYVEGLLSSNQKDVLMEEIVANYHANTKDAEVVLVEGLVPTRKHQFAQSLNYEIAKTLNAEIVFVMSQGTDTPEQLKERIELTRNSFGGAKNTNITGVIVNKLNAPVDEQGRTRPDLSEIFDDSSKAKVNNVDPAKLQESSPLPVLGAVPWSFDLIATRAIDMARHLNATIINEGDINTRRVKSVTFCARSIPHMLEHFRAGSLLVTSADRPDVLVAACLAAMNGVEIGALLLTGGYEMDARISKLCERAFATGLPVFMVNTNTWQTSLSLQSFNLEVPVDDHERIEKVQEYVANYINADWIESLTATSERSRRLSPPAFRYQLTELARKAGKRIVLPEGDEPRTVKAAAICAERGIATCVLLGNPAEINRVAASQGVELGAGIEIVDPEVVRESYVGRLVELRKNKGMTETVAREQLEDNVVLGTLMLEQDEVDGLVSGAVHTTANTIRPPLQLIKTAPGSSLVSSVFFMLLPEQVYVYGDCAINPDPTAEQLAEIAIQSADSAAAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQ

SEQ ID NO: 129 - protein, 400 aa, Escherichia coli
MSSKLVLVLNCGSSSLKFAIIDAVNGEEYLSGLAECFHLPEARIKWKMDGNKQEAALGAGAAHSEALNFIVNTILAQKPELSAQLTAIGHRIVHGGEKYTSSVVIDESVIQGIKDAASFAPLHNPAHLIGIEEALKSFPQLKDKNVAVFDTAFHQTMPEESYLYALPYNLYKEHGIRRYGAHGTSHFYVTQEAAKMLNKPVEELNIITCHLGNGGSVSAIRNGKCVDTSMGLTPLEGLVMGTRSGDIDPAIIFHLHDTLGMSVDAINKLLTKESGLLGLTEVTSDCRYVEDNYATKEDAKRAMDVYCHRLAKYIGAYTALMDGRLDAVVFTGGIGENAAMVRELSLGKLGVLGFEVDHERNLAARFGKSGFINKEGTRPAVVIPTNEELVIAQDASRLTA

SEQ ID NO: 130 - protein, 891 aa, Escherichia coli
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFATHGGYLLQGKELKAVQDVILKNGALNAAIVGQPAYKIAELAGFSVPENTKILIGEVTVVDESEPFAHEKLSPTLAMYRAKDFEDAVEKAEKLVAMGGIGHTSCLYTDQDNQPARVSYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSIVRKGAELANSFKPDVIIALGGGSPMDAAKIMWVMYEHPETHFEELALRFMDIRKRIYKFPKMGVKAKMIAVTTTSGTGSEVTPFAVVTDDATGQKYPLADYALTPDMAIVDANLVMDMPKSLCAFGGLDAVTHAMEAYVSVLASEFSDGQALQALKLLKEYLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLETLKAELGIPKSIREAGVQEADFLANVDKLSEDAFDDQCTGANPRYPLISELKQILLDTYYGRDYVEGETAAKKEAAPAKAEKKAKKSA

SEQ ID NO: 131 - protein, 78 aa, Escherichia coli
MSTIEERVKKIIGEQLGVKQEEVTNNASFVEDLGADSLDTVELVMALEEEFDTEIPDEEAEKITTVQAAIDYINGHQA

SEQ ID NO: 132 - protein, 262 aa, Escherichia coli
MGFLSGKRILVTGVASKLSIAYGIAQAMHREGAELAFTYQNDKLKGRVEEFAAQLGSDIVLQCDVAEDASIDTMFAELGKVWPKFDGFVHSIGFAPGDQLDGDYVNAVTREGFKIAHDISSYSFVAMAKACRSMLNPGSALLTLSYLGAERAIPNYNVMGLAKASLEANVRYMANAMGPEGVRVNAISAGPIRTLAASGIKDFRKMLAHCEAVTPIRRTVTIEDVGNSAAFLCSDLSAGISGEVVHVDGGFSIAAMNELELK

SEQ ID NO: 133 - protein, 406 aa, Escherichia coli
MKRAVITGLGIVSSIGNNQQEVLASLREGRSGITFSQELKDSGMRSHVWGNVKLDTTGLIDRKVVRFMSDASIYAFLSMEQAIADAGLSPEAYQNNPRVGLIAGSGGGSPRFQVFGADAMRGPRGLKAVGPYVVTKAMASGVSACLATPFKIHGVNYSISSACATSAHCIGNAVEQIQLGKQDIVFAGGGEELCWEMACEFDAMGALSTKYNDTPEKASRTYDAHRDGFVIAGGGGMVVVEELEHALARGAHIYAEIVGYGATSDGADMVAPSGEGAVRCMKMAMHGVDTPIDYLNSHGTSTPVGDVKELAAIREVFGDKSPAISATKAMTGHSLGAAGVQEAIYSLLMLEHGFIAPSINIEELDEQAAGLNIVTETTDRELTTVMSNSFGFGGTNATLVMRKLKD

SEQ ID NO: 134 - protein, 317 aa, Escherichia coli
MYTKIIGTGSYLPEQVRTNADLEKMVDTSDEWIVTRTGIRERHIAAPNETVSTMGFEAATRAIEMAGIEKDQIGLIVVATTSATHAFPSAACQIQSMLGIKGCPAFDVAAACAGFTYALSVADQYVKSGAVKYALVVGSDVLARTCDPTDRGTIIIFGDGAGAAVLAASEEPGIISTHLHADGSYGELLTLPNADRVNPENSIHLTMAGNEVFKVAVTELAHIVDETLAANNLDRSQLDWLVPHQANLRIISATAKKLGMSMDNVVVTLDRHGNTSAASVPCALDEAVRDGRIKPGQLVLLEAFGGGFTWGSALVRF

SEQ ID NO: 135 - protein, 309 aa, Escherichia coli [sequence omitted]

SEQ ID NO: 136 - protein, 413 aa, Escherichia coli
MSKRRVVVTGLGMLSPVGNTVESTWKALLAGQSGISLIDHFDTSAYATKFAGLVKDFNCEDIISRKEQRKMDAFIQYGIVAGVQAMQDSGLEITEENATRIGAAIGSGIGGLGLIEENHTSLMNGGPRKISPFFVPSTIVNMVAGHLTIMYGLRGPSISIATACTSGVHNIGHAARIIAYGDADVMVAGGAEKASTPLGVGGFGAARALSTRNDNPQAASRPWDKERDGFVLGDGAGMLVLEEYEHAKKRGAKIYAELVGFGMSSDAYHMTSPPENGAGAALAMANALRDAGIEASQIGYVNAHGTSTPAGDKAEAQAVKTIFGEAASRVLVSSTKSMTGHLLGAAGAVESIYSILALRDQAVPPTINLDNPDEGCDLDFVPHEARQVSGMEYTLCNSFGFGGTNGSLIFKKI

SEQ ID NO: 137 - protein, 244 aa, Escherichia coli
MNFEGKIALVTGASRGIGRAIAETLAARGAKVIGTATSENGAQAISDYLGANGKGLMLNVTDPASIESVLEKIRAEFGEVDILVNNAGITRDNLLMRMKDEEWNDIIETNLSSVFRLSKAVMRAMMKKRHGRIITIGSVVGTMGNGGQANYAAAKAGLIGFSKSLAREVASRGITVNVVAPGFIETDMTRALSDDQRAGILAQVPAGRLGGAQEIANAVAFLASDEAAYITGETLHVNGGMYMV

SEQ ID NO: 138 - protein, 172 aa, Escherichia coli
MVDKRESYTKEDLLASGRGELFGAKGPQLPAPNMLMMDRVVKMTETGGNFDKGYVEAELDINPDLWFFGCHFIGDPVMPGCLGLDAMWQLVGFYLGWLGGEGKGRALGVGEVKFTGQVLPTAKKVTYRIHFKRIVNRRLIMGLADGEVLVDGRLIYTASDLKVGLFQDTSAF

SEQ ID NO: 139 - protein, 151 aa, Escherichia coli
MTTNTHTLQIEEILELLPHRFPFLLVDRVLDFEEGRFLRAVKNVSVNEPFFQGHFPGKPIFPGVLILEAMAQATGILAFKSVGKLEPGELYYFAGIDEARFKRPVVPGDQMIMEVTFEKTRRGLTRFKGVALVDGKVVCEATMMCARSREA

SEQ ID NO: 140 - protein, 215 aa, Escherichia coli
MGVRAQQKEKTRRSLVEAAFSQLSAERSFASLSLREVAREAGIAPTSFYRHFRDVDELGLTMVDESGLMLRQLMRQARQRIAKGGSVIRTSVSTFMEFIGNNPNAFRLLLRERSGTSAAFRAAVAREIQHFIAELADYLELENHMPRAFTEAQAEAMVTIVFSAGAEALDVGVEQRRQLEERLVLQLRMISKGAYYWYRREQEKTAIIPGNVKDE

SEQ ID NO: 141 - protein, 262 aa, Escherichia coli
MGFLSGKRILVTGVASKLSIAYGIAQAMHREGAELAFTYQNDKLKGRVEEFAAQLGSDIVLQCDVAEDASIDTMFAELGKVWPKFDGFVHSIGFAPGDQLDGDYVNAVTREGFKIAHDISSYSFVAMAKACRSMLNPGSALLTLSYLGAERAIPNYNVMGLAKASLEANVRYMANAMGPEGVRVNAISAGPIRTLAASGIKDFRKMLAHCEAVTPIRRTVTIEDVGNSAAFLCSDLSAGIFGEVVHVDGGFSIAAMNELELK

SEQ ID NO: 142 - protein, 406 aa, Escherichia coli
MKRAVITGLGIVSSIGNNQQEVLASLREGRSGITFSQELKDSGMRSHVWGNVKLDTTGLIDRKVVRFMSDASIYAFLSMEQAIADAGLSPEAYQNNPRVGLIAGSGGGSPRFQVFGADAMRGPRGLKAVGPYVVTKAMASGVSACLATPFKIHGVNYSISSACATSAHCIGNAVEQIQLGKQDIVFAGGGEELCWEMACEFDAMGALSTKYNDTPEKASRTYDAHRDGFVIAGGGGMVVVEELEHALARGAHIYAEIVGYGATSDGADMVAPSGEGAVRCMKMAMHGVDTPIDYLNSHGTSTPVGDVKELAAIREVFGDKSPAISATKVMTGHSLGAAGVQEAIYSLLMLEHGFIAPSINIEELDEQAAGLNIVTETTDRELTTVMSNSFGFGGTNATLVMRKLKD

SEQ ID NO: 143 - protein, 307 aa, Escherichia coli
MTQFAFVFPGQGSQTVGMLADMAASYPIVEETFAEASAALGYDLWALTQQGPAEELNKTWQTQPALLTASVALYRVWQQQGGKAPAMMAGHSLGEYSALVCAGVIDFADAVRLVEMRGKFMQEAVPEGTGAMAAIIGLDDASIAKACEEAAEGQVVSPVNFNSPGQVVIAGHKEAVERAGAACKAAGAKRALPLPVSVPSHCALMKPAADKLAVELAKITFNAPTVPVVNNVDVKCETNGDAIRDALVRQLYNPVQQTKSVEYMAAQGVEHLYEVGPGKVLTGLTKRIVDTLTASALNEPSAMAAAL

SEQ ID NO: 144 - protein, 466 aa, Escherichia coli
MPHSYDYDAIVIGSGPGGEGAAMGLVKQGARVAVIERYQNVGGGCTHWGTIPSKALRHAVSRIIEFNQNPLYSDHSRLLRSSFADILNHADNVINQQTRMRQGFYERNHCEILQGNARFVDEHTLALDCPDGSVETLTAEKFVIACGSRPYHPTDVDFTHPRIYDSDSILSMHHEPRHVLIYGAGVIGCEYASIFRGMDVKVDLINTRDRLLAFLDQEMSDSLSYHFWNSGVVIRHNEEYEKIEGCDDGVIMHLKSGKKLKADCLLYANGRTGNTDSLALQNIGLETDSRGQLKVNSMYQTAQPHVYAVGDVIGYPSLASAAYDQGRIAAQALVKGEATAHLIEDIPTGIYTIPEISSVGKTEQQLTAMKVPYEVGRAQFKHLARAQIVGMNVGTLKILFHRETKEILGIHCFGERAAEIIHIGQAIMEQKGGGNTIEYFVNTTFNYPTMAEAYRVAALNGLNRLF

SEQ ID NO: 145 - protein, 510 aa, Escherichia coli
MRIGIPRERLTNETRVAATPKTVEQLLKLGFTVAVESGAGQLASFDDKAFVQAGAEIVEGNSVWQSEIILKVNAPLDDEIALLNPGTTLVSFIWPAQNPELMQKLAERNVTVMAMDSVPRISRAQSLDALSSMANIAGYRAIVEAAHEFGRFFTGQITAAGKVPPAKVMVIGAGVAGLAAIGAANSLGAIVRAFDTRPEVKEQVQSMGAEFLELDFKEEAGSGDGYAKVMSDAFIKAEMELFAAQAKEVDIIVTTALIPGKPAPKLITREMVDSMKAGSVIVDLAAQNGGNCEYTVPGEIFTTENGVKVIGYTDLPGRLPTQSSQLYGTNLVNLLKLLCKEKDGNITVDFDDVVIRGVTVIRAGEITWPAPPIQVSAQPQAAQKAAPEVKTEEKCTCSPWRKYALMALAIILFGWMASVAPKEFLGHFTVFALACVVGYYVVWNVSHALHTPLMSVTNAISGIIVVGALLQIGQGGWVSFLSFIAVLIASINIFGGFTVTQRMLKMFRKN

SEQ ID NO: 146 - protein, 462 aa, Escherichia coli
MSGGLVTAAYIVAAILFIFSLAGLSKHETSRQGNNFGIAGMAIALIATIFGPDTGNVGWILLAMVIGGAIGIRLAKKVEMTEMPELVAILHSFVGLAAVLVGFNSYLHHDAGMAPILVNIHLTEVFLGIFIGAVTFTGSVVAFGKLCGKISSKPLMLPNRHKMNLAALVVSFLLLIVFVRTDSVGLQVLALLIMTAIALVFGWHLVASIGGADMPVVVSMLNSYSGWAAAAAGFMLSNDLLIVTGALVGSSGAILSYIMCKAMNRSFISVIAGGFGTDGSSTGDDQEVGEHREITAEETAELLKNSHSVIITPGYGMAVAQAQYPVAEITEKLRARGINVRFGIHPVAGRLPGHMNVLLAEAKVPYDIVLEMDEINDDFADTDTVLVIGANDTVNPAAQDDPKSPIAGMPVLEVWKAQNVIVFKRSMNTGYAGVQNPLFFKENTHMLFGDAKASVDAILKAL

SEQ ID NO: 147 - protein, 319 aa, Escherichia coli
MSLNFLDFEQPIAELEAKIDSLTAVSRQDEKLDINIDEEVHRLREKSVELTRKIFADLGAWQIAQLARHPQRPYTLDYVRLAFDEFDELAGDRAYADDKAIVGGIARLDGRPVMIIGHQKGRETKEKIRRNFGMPAPEGYRKALRLMQMAERFKMPIITFIDTPGAYPGVGAEERGQSEAIARNLREMSRLGVPVVCTVIGEGGSGGALAIGVGDKVNMLQYSTYSVISPEGCASILWKSADKAPLAAEAMGIIAPRLKELKLIDSIIPEPLGGAHRNPEAMAASLKAQLLADLADLDVLSTEDLKNRRYQRLMSYGYA

SEQ ID NO: 148 - protein, 156 aa, Escherichia coli
MDIRKIKKLIELVEESGISELEISEGEESVRISRAAPAASFPVMQQAYAAPMMQQPAQSNAAAPATVPSMEAPAAAEISGHIVRSPMVGTFYRTPSPDAKAFIEVGQKVNVGDTLCIVEAMKMMNQIEADKSGTVKAILVESGQPVEFDEPLVVIE

SEQ ID NO: 149 - protein, 449 aa, Escherichia coli
MLDKIVIANRGEIALRILRACKELGIKTVAVHSSADRDLKHVLLADETVCIGPAPSVKSYLNIPAIISAAEITGAVAIHPGYGFLSENANFAEQVERSGFIFIGPKAETIRLMGDKVSAIAAMKKAGVPCVPGSDGPLGDDMDKNRAIAKRIGYPVIIKASGGGGGRGMRVVRGDAELAQSISMTRAEAKAAFSNDMVYMEKYLENPRHVEIQVLADGQGNAIYLAERDCSMQRRHQKVVEEAPAPGITPELRRYIGERCAKACVDIGYRGAGTFEFLFENGEFYFIEMNTRIQVEHPVTEMITGVDLIKEQLRIAAGQPLSIKQEEVHVRGHAVECRINAEDPNTFLPSPGKITRFHAPGGFGVRWESHIYAGYTVPPYYDSMIGKLICYGENRDVAIARMKNALQELIIDGIKTNVDLQIRIMNDENFQHGGTNIHYLEKKLGLQEK

SEQ ID NO: 150 - protein, 304 aa, Escherichia coli
MSWIERIKSNITPTRKASIPEGVWTKCDSCGQVLYRAELERNLEVCPKCDHHMRMTARNRLHSLLDEGSLVELGSELEPKDVLKFRDSKKYKDRLASAQKETGEKDALVVMKGTLYGMPVVAAAFEFAFMGGSMGSVVGARFVRAVEQALEDNCPLICFSASGGARMQEALMSLMQMAKTSAALAKMQERGLPYISVLTDPTMGGVSASFAMLGDLNIAEPKALIGFAGPRVIEQTVREKLPPGFQRSEFLIEKGAIDMIVRRPEMRLKLASILAKLMNLPAPNPEAPREGVVVPPVPDQEPEA

SEQ ID NO: 151 - protein, 887 aa, Escherichia coli
MSERFPNDVDPIETRDWLQAIESVIREEGVERAQYLIDQLLAEARKGGVNVAAGTGISNYINTIPVEEQPEYPGNLELERRIRSAIRWNAIMTVLRASKKDLELGGHMASFQSSATIYDVCFNHFFRARNEQDGGDLVYFQGHISPGVYARAFLEGRLTQEQLDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIINELEGIFEGAGWNVIKVMWGSRWDELLRKDTSGKLIQLMNETVDGDYQTFKSKDGAYVREHFFGKYPETAALVADWTDEQIWALNRGGHDPKKIYAAFKKAQETKGKATVILAHTIKGYGMGDAAEGKNIAHQVKKMNMDGVRHIRDRFNVPVSDADIEKLPYITFPEGSEEHTYLHAQRQKLHGYLPSRQPNFTEKLELPSLQDFGALLEEQSKEISTTIAFVRALNVMLKNKSIKDRLVPIIADEARTFGMEGLFRQIGIYSPNGQQYTPQDREQVAYYKEDEKGQILQEGINELGAGCSWLAAATSYSTNNLPMIPFYIYYSMFGFQRIGDLCWAAGDQQARGFLIGGTSGRTTLNGEGLQHEDGHSHIQSLTIPNCISYDPAYAYEVAVIMHDGLERMYGEKQENVYYYITTLNENYHMPAMPEGAEEGIRKGIYKLETIEGSKGKVQLLGSGSILRHVREAAEILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAIAKFNIDADKVNPRLA

SEQ ID NO: 152 - protein, 630 aa, Escherichia coli
MAIEIKVPDIGADEVEITEILVKVGDKVEAEQSLITVEGDKASMEVPSPQAGIVKEIKVSVGDKTQTGALIMIFDSADGAADAAPAQAEEKKEAAPAAAPAAAAAKDVNVPDIGSDEVEVTEILVKVGDKVEAEQSLITVEGDKASMEVPAPFAGTVKEIKVNVGDKVSTGSLIMVFEVAGEAGAAAPAAKQEAAPAAAPAPAAGVKEVNVPDIGGDEVEVTEVMVKVGDKVAAEQSLITVEGDKASMEVPAPFAGVVKELKVNVGDKVKTGSLIMIFEVEGAAPAAAPAKQEAAAPAPAAKAEAPAAAPAAKAEGKSEFAENDAYVHATPLIRRLAREFGVNLAKVKGTGRKGRILREDVQAYVKEAIKRAEAAPAATGGGIPGMLPWPKVDFSKFGEIEEVELGRIQKISGANLSRNWVMIPHVTHFDKTDITELEAFRKQQNEEAAKRKLDVKITPVVFIMKAVAAALEQMPRFNSSLSEDGQRLTLKKYINIGVAVDTPNGLVVPVFKDVNKKGIIELSRELMTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 153 - protein, 474 aa, Escherichia coli [sequence omitted]

SEQ ID NO: 154 - protein, 316 aa, Escherichia coli
MSIKEQTLMTPYLQFDRNQWAALRDSVPMTLSEDEIARLKGINEDLSLEEVAEIYLPLSRLLNFYISSNLRRQAVLEQFLGTNGQRIPYIISIAGSVAVGKSTTARVLQALLSRWPEHRRVELITTDGFLHPNQVLKERGLMKKKGFPESYDMHRLVKFVSDLKSGVPNVTAPVYSHLIYDVIPDGDKTVVQPDILILEGLNVLQSGMDYPHDPHHVFVSDFVDFSIYVDAPEDLLQTWYINRFLKFREGAFTDPDSYFHNYAKLTKEEAIKTAMTLWKEINWLNLKQNILPTRERASLILTKSANHAVEEVRLRK

SEQ ID NO: 155 - protein, 126 aa, Escherichia coli
MIRTMLQGKLHRVKVTHADLHYEGSCAIDQDFLDAAGILENEAIDIWNVTNGKRFSTYAIAAERGSRIISVNGAAAHCASVGDIVIIASFVTMPDEEARTWRPNVAYFEGDNEMKRTAKAIPVQVA

SEQ ID NO: 156 - protein, 434 aa, Escherichia coli
MKTRTQQIEELQKEWTQPRWEGITRPYSAEDVVKLRGSVNPECTLAQLGAAKMWRLLHGESKKGYINSLGALTGGQALQQAKAGIEAVYLSGWQVAADANLAASMYPDQSLYPANSVPAVVERINNTFRRADQIQWSAGIEPGDPRYVDYFLPIVADAEAGFGGVLNAFELMKAMIEAGAAAVHFEDQLASVKKCGHMGGKVLVPTQEAIQKLVAARLAADVTGVPTLLVARTDADAADLITSDCDPYDSEFITGERTSEGFFRTHAGIEQAISRGLAYAPYADLVWCETSTPDLELARRFAQAIHAKYPGKLLAYNCSPSFNWQKNLDDKTIASFQQQLSDMGYKFQFITLAGIHSMWFNMFDLANAYAQGEGMKHYVEKVQQPEFAAAKDGYTFVSHQQEVGTGYFDKVTTIIQGGTSSVTALTGSTEESQF

SEQ ID NO: 157 - protein, 533 aa, Escherichia coli
MTEQATTTDELAFTRPYGEQEKQILTAEAVEFLTELVTHFTPQRNKLLAARIQQQQDIDNGTLPDFISETASIRDADWKIRGIPADLEDRRVEITGPVERKMVINALNANVKVFMADFEDSLAPDWNKVIDGQINLRDAVNGTISYTNEAGKIYQLKPNPAVLICRVRGLHLPEKHVTWRGEAIPGSLFDFALYFFHNYQALLAKGSGPYFYLPKTQSWQEAAWWSEVFSYAEDRFNLPRGTIKATLLIETLPAVFQMDEILHALRDHIVGLNCGRWDYIFSYIKTLKNYPDRVLPDRQAVTMDKPFLNAYSRLLIKTCHKRGAFAMGGMAAFIPSKDEEHNNQVLNKVKADKSLEANNGHDGTWIAHPGLADTAMAVFNDILGSRKNQLEVMREQDAPITADQLLAPCDGERTEEGMRANIRVAVQYIEAWISGNGCVPIYGLMEDAATAEISRTSIWQWIHHQKTLSNGKPVTKALFRQMLGEEMKVIASELGEERFSQGRFDDAARLMEQITTSDELIDFLTLPGYRLLA

SEQ ID NO: 158 - protein, 578 aa, Escherichia coli
MPRGLELLIAQTILQGFDAQYGRFLEVTSGAQQRFEQADWHAVQQAMKNRIHLYDHHVGLVVEQLRCITNGQSTDAAFLLRVKEHYTRLLPDYPRFEIAESFFNSVYCRLFDHRSLTPERLFIFSSQPERRFRTIPRPLAKDFHPDHGWESLLMRVISDLPLRLRWQNKSRDIHYIIRHLTETLGTDNLAESHLQVANELFYRNKAAWLVGKLITPSGTLPFLLPIHQTDDGELFIDTCLTTTAEASIVFGFARSYFMVYAPLPAALVEWLREILPGKTTAELYMAIGCQKHAKTESYREYLVYLQGCNEQFIEAPGIRGMVMLVFTLPGFDRVFKVIKDRFAPQKEMSAAHVRACYQLVKEHDRVGRMADTQEFENFVLEKRHISPALMELLLQEAAEKITDLGEQIVIRHLYIERRMVPLNIWLEQVEGQQLRDAIEEYGNAIRQLAAANIFPGDMLFKNFGVTRHGRVVFYDYDEICYMTEVNFRDIPPPRYPEDELASEPWYSVSPGDVFPEEFRHWLCADPRIGPLFEEMHADLFRADYWRALQNRIREGHVEDVYAYRRRQRFSVRYGEMLF

SEQ ID NO: 159 - protein, 331 aa, Escherichia coli
MTIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 160 - protein, 480 aa, Escherichia coli
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQDAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSANDGVAAASEAVNLLRDKGYLMSGDLVIVTQGDVMSTVGSTNTTRILTVE

SEQ ID NO: 161 - protein, 470 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 162 - protein, 427 aa, Escherichia coli
MADTKAKLTLNGDTAVELDVLKGTLGQDVIDIRTLGSKGVFTFDPGFTSTASCESKITFIDGDEGILLHRGFPIDQLATDSNYLEVCYILLNGEKPTQEQYDEFKTTVTRHTMIHEQITRLFHAFRRDSHPMAVMCGITGALAAFYHDSLDVNNPRHREIAAFRLLSKMPTMAAMCYKYSIGQPFVYPRNDLSYAGNFLNMMFSTPCEPYEVNPILERAMDRILILHADHEQNASTSTVRTAGSSGANPFACIAAGIASLWGPAHGGANEAALKMLEEISSVKHIPEFVRRAKDKNDSFRLMGFGHRVYKNYDPRATVMRETCHEVLKELGTKDDLLEVAMELENIALNDPYFIEKKLYPNVDFYSGIILKAMGIPSSMFTVIFAMARTVGWIAHWSEMHSDGMKIARPRQLYTGYEKRDFKSDIKR

SEQ ID NO: 163 - protein, 566 aa, Synechococcus sp.
MQITNKIHFRNIRGDIFGGLTAAVIALPMALAFGVASGAGAEAGLWGAVLVGFFAALFGGTPTLISEPTGPMTVVMTAVIAHFTASAATPEEGLAIAFTVVMMAGVFQIIFGSLKLGKYVTMMPYTVISGFMSGIGIILVILQLAPFLGQASPGGGVIGTLQNLPTLLSNIQPGETALALGTVAIIWFMPEKFKKVIPPQLVALVLGTVIAFFVFPPEVSDLRRIGEIRAGFPELVRPSFSPVEFQRMILDAAVLGMLGCIDALLTSVVADSLTRTEHNSNKELIGQGLGNLFSGLFGGIAGAGATMGTVVNIQSGGRTALSGLVRAFVLLVVILGAASLTATIPLAVLAGIAFKVGVDIIDWSFLKRAHEISPKGALIMYGVILLTVLVDLIVAVGVGVFVANVLTIERMSNLQSEKVQTVSDADDNIRLTTTEKRWLDEGQGRVLLFQLSGPMIFGVAKAIAREHNAMGDCDALVFDIGEVPHMGVTASLALENAIEEALDKERQVYIVGAAGQTRRRLEKLKLFKRVPPDKCLMSREEALKNAVLGIYPHLADGVTAPSSEMG

SEQ ID NO: 164 - protein, 1486 aa, Escherichia coli
MLYDKSLERDNCGFGLIAHIEGEPSHKVVRTAIHALARMQHRGAILADGKTGDGCGLLLQKPDRFFRIVAQERGWRLAKNYAVGMLFLNKDPELAAAARRIVEEELQRETLSIVGWRDVPTNEGVLGEIALSSLPRIEQIFVNAPAGWRPRDMERRLFIARRRIEKRLEADKDFYVCSLSNLVNIYKGLCMPTDLPRFYLDLADLRLESAICLFHQRFSTNTVPRWPLAQPFRYLAHNGEINTITGNRQWARARTYKFQTPLIPDLHDAAPFVNETGSDSSSMDNMLELLLAGGMDIIRAMRLLVPPAWQNNPDMDPELRAFFDFNSMHMEPWDGPAGIVMSDGRFAACNLDRNGLRPARYVITKDKLITCASEVGIWDYQPDEVVEKGRVGPGELMVIDTRSGRILHSAETDDDLKSRHPYKEWMEKNVRRLVPFEDLPDEEVGSRELDDDTLASYQKQFNYSAEELDSVIRVLGENGQEAVGSMGDDTPFAVLSSQPRIIYDYFRQQFAQVTNPPIDPLREAHVMSLATSIGREMNVFCEAEGQAHRLSFKSPILLYSDFKQLTTMKEEHYRADTLDITFDVTKTTLEATVKELCDKAEKMVRSGTVLLVLSDRNIAKDRLPVPAPMAVGAIQTRLVDQSLRCDANIIVETASARDPHHFAVLLGFGATAIYPYLAYETLGRLVDTHAIAKDYRTVMLNYRNGINKGLYKIMSKMGISTIASYRCSKLFEAVGLHDDVVGLCFQGAVSRIGGASFEDFQQDLLNLSKRAWLARKPISQGGLLKYVHGGEYHAYNPDVVRTLQQAVQSGEYSDYQEYAKLVNERPATTLRDLLAITPGENAVNIADVEPASELFKRFDTAAMSIGALSPEAHEALAEAMNSIGGNSNSGEGGEDPARYGTNKVSRIKQVASGRFGVTPAYLVNADVIQIKVAQGAKPGEGGQLPGDKVTPYIAKLRYSVPGVTLISPPPHHDIYSIEDLAQLIFDLKQVNPKAMISVKLVSEPGVGTIATGVAKAYADLITIAGYDGGTGASPLSSVKYAGCPWELGLVETQQALVANGLRHKIRLQVDGGLKTGVDIIKAAILGAESFGFGTGPMVALGCKYLRICHLNNCATGVATQDDKLRKNHYHGLPFKVTNYFEFIARETRELMAQLGVTRLVDLIGRTDLLKELDGFTAKQQKLALSKLLETAEPHPGKALYCTENNPPFDNGLLNAQLLQQAKPFVDERQSKTFWFDIRNTDRSVGASLSGYIAQTHGDQGLAADPIKAYFNGTAGQSFGVWNAGGVELYLTGDANDYVGKGMAGGLIAIRPPVGSAFRSHEASIIGNTCLYGATGGRLYAAGRAGERFGVRNSGAITVVEGIGDNGCEYMTGGIVCILGKTGVNFGAGMTGGFAYVLDESGDFRKRVNPELVEVLSVDALAIHEEHLRGLITEHVQHTGSQRGEEILANWSTFATKFALVKPKSSDVKALLGHRSRSAAELRVQAQ

SEQ ID NO: 165 - protein, 472 aa, Escherichia coli
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDMSGVKQTGKKVAIIGAGPAGLACADVLTRNGVKAVVFDRHPEIGGLLTFGIPAFKLEKEVMTRRREIFTGMGIEFKLNTEVGRDVQLDDLLSDYDAVFLGVGTYQSMRGGLENEDADGVYAALPFLIANTKQLMGFGETRDEPFVSMEGKRVVVLGGGDTAMDCVRTSVRQGAKHVTCAYRRDEENMPGSRREVKNAREEGVEFKFNVQPLGIEVNGNGKVSGVKMVRTEMGEPDAKGRRRAEIVAGSEHIVPADAVIMAFGFRPHNMEWLAKHSVELDSQGRIIAPEGSDNAFQTSNPKIFAGGDIVRGSDLVVTAIAEGRKAADGIMNWLEV

SEQ ID NO: 166 - protein, 447 aa, Escherichia coli
MDQTYSLESFLNHVQKRDPNQTEFAQAVREVMTTLWPFLEQNPKYRQMSLLERLVEPERVIQFRVVWVDDRNQIQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSLPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 167 - protein, 220 aa, Escherichia coli
MKDIDTLISNNALWSKMLVEEDPGFFEKLAQAQKPRFLWIGCSDSRVPAERLTGLEPGELFVHRNVANLVIHTDLNCLSVVQYAVDVLEVEHIIICGHYGCGGVQAAVENPELGLINNWLLHIRDIWFKHSSLLGEMPQERRLDTLCELNVMEQVYNLGHSTIMQSAWKRGQKVTIHGWAYGIHDGLLRDLDVTATNRETLEQRYRHGISNLKLKHANHK

SEQ ID NO: 168 - protein, 219 aa, Escherichia coli
MKEIIDGFLKFQREAFPKREALFKQLATQQSPRTLFISCSDSRLVPELVTQREPGDLFVIRNAGNIVPSYGPEPGGVSASVEYAVAALRVSDIVICGHSNCGAMTAIASCQCMDHMPAVSHWLRYADSARVVNEARPHSDLPSKAAAMVRENVIAQLANLQTHPSVRLALEEGRIALHGWVYDIESGSIAAFDGATRQFVPLAANPRVCAIPLRQPTAA

SEQ ID NO: 169 - protein, 156 aa, Escherichia coli
MIQSQINRNIRLDLADAILLSKAKKDLSFAEIADGTGLAEAFVTAALLGQQALPADAARLVGAKLDLDEDSILLLQMIPLRGCIDDRIPTDPTMYRFYEMLQVYGTTLKALVHEKFGDGIISAINFKLDVKKVADPEGGERAVITLDGKYLPTKPF

SEQ ID NO: 170 - protein, 344 aa, Escherichia coli
MMNSTNKLSVIIPLYNAGDDFRTCMESLITQTWTALEIIIINDGSTDNSVEIAKYYAENYPHVRLLHQANAGASVARNRGIEVATGKYVAFVDADDEVYPTMYETLMTMALEDDLDVAQCNADWCFRETGETWQSIPTDRLRSTGVLTGPDWLRMGLSSRRWTHVVWMGVYRRDVIVKNNIKFIAGLHHQDIVWTTEFMFNALRARYTEQSLYKYYLHNTSVSRLHRQGNKNLNYQRHYIKITRLLEKLNRNYADKIMIYPEFHQQITYEALRVCHAVRKEPDILTRQRMIAEIFTSGMYKRLITNVRSVKVGYQALLWSFRLWQWRDKTRSHHRITRSAFNLR

SEQ ID NO: 171 - protein, 609 aa, Escherichia coli
MCGIVGAIAQRDVAEILLEGLRRLEYRGYDSAGLAVVDAEGHMTRLRRLGKVQMLAQAAEEHPLHGGTGIAHTRWATHGEPSEVNAHPHVSEHIVVVHNGIIENHEPLREELKARGYTFVSETDTEVIAHLVNWELKQGGTLREAVLRAIPQLRGAYGTVIMDSRHPDTLLAARSGSPLVIGLGMGENFIASDQLALLPVTRRFIFLEEGDIAEITRRSVNIFDKTGAEVKRQDIESNLQYDAGDKGIYRHYMQKEIYEQPNAIKNTLTGRISHGQVDLSELGPNADELLSKVEHIQILACGTSYNSGMVSRYWFESLAGIPCDVEIASEFRYRKSAVRRNSLMITLSQSGETADTLAGLRLSKELGYLGSLAICNVPGSSLVRESDLALMTNAGTEIGVASTKAFTTQLTVLLMLVAKLSRLKGLDASIEHDIVHGLQALPSRIEQMLSQDKRIEALAEDFSDKHHALFLGRGDQYPIALEGALKLKEISYIHAEAYAAGELKHGPLALIDADMPVIVVAPNNELLEKLKSNIEEVRARGGQLYVFADQDAGFVSSDNMHIIEMPHVEEVIAPIFYTVPLQLLAYHVALIKGTDVDQPRNLAKSVTVE

SEQ ID NO: 172 - protein, 474 aa, Escherichia coli [sequence omitted]

SEQ ID NO: 173 - protein, 316 aa, Escherichia coli
MSIKEQTLMTPYLQFDRNQWAALRDSVPMTLSEDEIARLKGINEDLSLEEVAEIYLPLSRLLNFYISSNLRRQAVLEQFLGTNGQRIPYIISIAGSVAVGKSTTAAVLQALLSRWPEHRRVELITTDGFLHPNQVLKERGLMKKKGFPESYDMHRLVKFVSDLKSGVPNVTAPVYSHLIYDVIPDGDKTVVQPDILILEGLNVLQSGMDYPHDPHHVFVSDFVDFSIYVDAPEDLLQTWYINRFLKFREGAFTDPDSYFHNYAKLTKEEAIKTAMTLWKEINWLNLKQNILPTRERASLILTKSANHAVEEVRLRK

SEQ ID NO: 174 - protein, 477 aa, Escherichia coli
MTQSRLHAAQNALAKLHERRGNTFYPHFHLAPPAGWMNDPNGLIWFNDRYHAFYQHHPMSEHWGPMHWGHATSDDMIHWQHEPIALAPGDENDKDGCFSGSAVDDNGVLSLIYTGHVWLDGAGNDDAIREVQCLATSRDGIHFEKQGVILTPPEGIMHFRDPKVWREADTWWMVVGAKDPGNTGQILLYRGSSLREWTFDRVLAHADAGESYMWECPDFFSLGDQHYLMFSPQGMNAEGYSYRNRFQSGVIPGMWSPGRLFAQSGHFTELDNGHDFYAPQSFVAKDGRRIVIGWMDMWESPMPSKREGWAGCMTLARELSESNGKLLQRPVHEAESLRQQHQSISPRTISNKYVLQENAQAVEIQLQWALKNSDAEHYGLQLGAGMRLYIDNQSERLVLWRYYPHENLDGYRSIPLPQGDMLALRIFIDTSSVEVFINDGEAVMSSRIYPQPEERELSLYASHGVAVLQHGALWQLG

SEQ ID NO: 175 - protein, 415 aa, Escherichia coli
MALNIPFRNAYYRFASSYSFLFFISWSLWWSLYAIWLKGHLGLTGTELGTLYSVNQFTSILFMMFYGIVQDKLGLKKPLIWCMSFILVLTGPFMIYVYEPLLQSNFSVGLILGALFFGLGYLAGCGLLDSFTEKMARNFHFEYGTARAWGSFGYAIGAFFAGIFFSISPHINFWLVSLFGAVFMMINMRFKDKDHQCIAADAGGVKKEDFIAVFKDRNFWVFVIFIVGTWSFYNIFDQQLFPVFYAGLFESHDVGTRLYGYLNSFQVVLEALCMAIIPFFVNRVGPKNALLIGVVIMALRILSCALFVNPWIISLVKLLHAIEVPLCVISVFKYSVANFDKRLSSTIFLIGFQIASSLGIVLLSTPTGILFDHAGYQTVFFAISGIVCLMLLFGIFFLSKKREQIVMETPVPSAI

SEQ ID NO: 176 - protein, 307 aa, Escherichia coli
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTAIRHAGGFVSFDPNIREDLWQDEHLLRLCLRQALQLADVVKLSEEEWRLISGKTQNDRDICALAKEYEIAMLLVTKGAEGVVVCYRGQVHHFAGMSVNCVDSTGAGDAFVAGLLTGLSSTGLSTDEREMRRIIDLAQRCGALAVTAKGAMTALPCRQELESEK

SEQ ID NO: 177 - protein, 464 aa, Escherichia coli
MPDAKKQGRSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 178 - protein, 382 aa, Escherichia coli
MSLKEKTQSLFANAFGYPATHTIQAPGRVNLIGEHTDYNDGFVLPCAIDYQTVISCAPRDDRKVRVMAADYENQLDEFSLDAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLVEIVKAVIGDKGGVRMTGGGFGGCIVALIPEELVPAVQQAVAEQYEAKTGIKETFYVCKPSQGAGQC

SEQ ID NO: 179 - protein, 415 aa, Escherichia coli
MALNIPFRNAYYRFASSYSFLFFISWSLWWSLYAIWLKGHLGLTGTELGTLYSVNQFTSILFMMFYGIVQDKLGLKKPLIWCMSFILVLTGPFMIYVYEPLLQSNFSVGLILGALFFGLGYLAGCGLLDSFTEKMARNFHFEYGTARAWGSFGYAIGAFFAGIFFSISPHINFWLVSLFGAVFMMINMRFKDKDHQCIAADAGGVKKEDFIAVFKDRNFWVFVIFIVGTWSFYDIFDQQLFPVFYAGLFESHDVGTRLYGYLNSFQVVLEALCMAIIPFFVNRVGPKNALLIGVVIMALRILSCALFVNPWVISLVKLLHAIEVPLCVISVFKYSVANFDKRLSSTIFLIGFQIASSLGIVLLSTPTGILFDHAGYQTVFFAISGIVCLMLLFGIFFLSKKREQIVMETPVPSAI

SEQ ID NO: 180 - protein, 814 aa, Escherichia coli [sequence omitted]

SEQ ID NO: 181 - protein, 561 aa, Escherichia coli
MKKVWLNRYPADVPTEINPDRYQSLVDMFEQSVARYADQPAFVNMGEVMTFRKLEERSRAFAAYLQQGLGLKKGDRVALMMPNLLQYPVALFGILRAGMIVVNVNPLYTPRELEHQLNDSGASAIVIVSNFAHTLEKVVDKTAVQHVILTRMGDQLSTAKGTVVNFVVKYIKRLVPKYHLPDAISFRSALHNGYRMQYVKPELVPEDLAFLQYTGGTTGVAKGAMLTHRNMLANLEQVNATYGPLLHPGKELVVTALPLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDDNEVPPGQPGELCVKGPQVMLGYWQRPDATDEIIKNGWLHTGDIAVMDEEGFLRIVDRKKDMILVSGFNVYPNEIEDVVMQHPGVQEVAAVGVPSGSSGEAVKIFVVKKDPSLTEESLVTFCRRQLTGYKVPKLVEFRDELPKSNVGKILRRELRDEARGKVDNKA

SEQ ID NO: 182 - protein, 387 aa, Escherichia coli
MEQVVIVDAIRTPMGRSKGGAFRNVRAEDLSAHLMRSLLARNPALEAAALDDIYWGCVQQTLEQGFNIARNAALLAEVPHSVPAVTVNRLCGSSMQALHDAARMIMTGDAQACLVGGVEHMGHVPMSHGVDFHPGLSRNVAKAAGMMGLTAEMLARMHGISREMQDAFAARSHARAWAATQSAAFKNEIIPTGGHDADGVLKQFNYDEVIRPETTVEALATLRPAFDPVNGMVTAGTSSALSDGAAAMLVMSESRAHELGLKPRARVRSMAVVGCDPSIMGYGPVPASKLALKKAGLSASDIGVFEMNEAFAAQILPCIKDLGLIEQIDEKINLNGGAIALGHPLGCSGARISTTLLNLMERKDVQFGLATMCIGLGQGIATVFERV

SEQ ID NO: 183 - protein, 729 aa, Escherichia coli
MLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLVEGAKAVLRQAINGDLDWKAKRQPKLEPLKLSKIEATMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDIVVEAVVENPKVKKAVLAETEQKVRQDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWRYKEDSKGKPKKEEDAAVEDLLAEVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 184 - protein, 436 aa, Escherichia coli
MGQVLPLVTRQGDRIAIVSGLRTPFARQATAFHGIPAVDLGKMVVGELLARSEIPAEVIEQLVFGQVVQMPEAPNIAREIVLGTGMNVHTDAYSVSRACATSFQAVANVAESLMAGTIRAGIAGGADSSSVLPIGVSKKLARVLVDVNKARTMSQRLKLFSRLRLRDLMPVPPAVAEYSTGLRMGDTAEQMAKTYGITREQQDALAHRSHQRAAQAWSDGKLKEEVMTAFIPPYKQPLVEDNNIRGNSSLADYAKLRPAFDRKHGTVTAANSTPLTDGAAAVILMTESRAKELGLVPLGYLRSYAFTAIDVWQDMLLGPAWSTPLALERAGLTMSDLTLIDMHEAFAAQTLANIQLLGSERFAREALGRAHATGEVDDSKFNVLGGSIAYGHPFAATGARMITQTLHELRRRGGGFGLVTACAAGGLGAAMVLEAE

SEQ ID NO: 185 - protein, 714 aa, Escherichia coli
MEMTSAFTLNVRLDNIAVITIDVPGEKMNTLKAEFASQVRAIIKQLRENKELRGVVFVSAKPDNFIAGADINMIGNCKTAQEAEALARQGQQLMAEIHALPIQVIAAIHGACLGGGLELALACHGRVCTDDPKTVLGLPEVQLGLLPGSGGTQRLPRLIGVSTALEMILTGKQLRAKQALKLGLVDDVVPHSILLEAAVELAKKERPSSRPLPVRERILAGPLGRALLFKMVGKKTEHKTQGNYPATERILEVVETGLAQGTSSGYDAEARAFGELAMTPQSQALRSIFFASTDVKKDPGSDAPPAPLNSVGILGGGLMGGGIAYVTACKAGIPVRIKDINPQGINHALKYSWDQLEGKVRRRHLKASERDKQLALISGTTDYRGFAHRDLIIEAVFENLELKQQMVAEVEQNCAAHTIFASNTSSLPIGDIAAHATRPEQVIGLHFFSPVEKMPLVEIIPHAGTSAQTIATTVKLAKKQGKTPIVVRDKAGFYVNRILAPYINEAIRMLTQGERVEHIDAALVKFGFPVGPIQLLDEVGIDTGTKIIPVLEAAYGERFSAPANVVSSILNDDRKGRKNGRGFYLYGQKGRKSKKQVDPAIYPLIGTQGQGRISAPQVAERCVMLMLNEAVRCVDEQVIRSVRDGDIGAVFGIGFPPFLGGPFRYIDSLGAGEVVAIMQRLATQYGSRFTPCERLVEMGARGESFWKTTATDLQ

SEQ ID NO: 186 - protein, 383 aa, Escherichia coli
MDFSLTEEQELLLASIRELITTNFPEEYFRTCDQNGTYPREFMRALADNGISMLGVPEEFGGIPADYVTQMLALMEVSKCGAPAFLITNGQCIHSMRRFGSAEQLRKTAESTLETGDPAYALALTEPGAGSDNNSATTTYTRKNGKVYINGQKTFITGAKEYPYMLVLARDPQPKDPKKAFTLWWVDSSKPGIKINPLHKIGWHMLSTCEVYLDNVEVEESDMVGEEGMGFLNVMYNFEMERLINAARSTGFAECAFEDAARYANQRIAFGKPIGHNQMIQEKLALMAIKIDNMRNMVLKVAWQADQHQSLRTSAALAKLYCARTAMEVIDDAIQIMGGLGYTDEARVSRFWRDVRCERIGGGTDEIMIYVAGRQILKDYQNK

SEQ ID NO: 187 - protein, 401 aa, Escherichia coli
MREAFICDGIRTPIGRYGGALSSVRADDLAAIPLRELLVRNPRLDAECIDDVILGCANQAGEDNRNVARMATLLAGLPQSVSGTTINRLCGSGLDALGFAARAIKAGDGDLLIAGGVESMSRAPFVMGKAASAFSRQAEMFDTTIGWRFVNPLMAQQFGTDSMPETAENVAELLKISREDQDSFALRSQQRTAKAQSSGILAEEIVPVVLKNKKGVVTEIQHDEHLRPETTLEQLRGLKAPFRANGVITAGNASGVNDGAAALIIASEQMAAAQGLTPRARIVAMATAGVEPRLMGLGPVPATRRVLERAGLSIHDMDVIELNEAFAAQALGVLRELGLPDDAPHVNPNGGAIALGHPLGMSGARLALAASHELHRRNGRYALCTMCIGVGQGIAMILERV

SEQ ID NO: 188 - protein, 393 aa, Escherichia coli
MKDVVIVGALRTPIGCFRGALAGHSAVELGSLVVKALIERTGVPAYAVDEVILGQVLTAGAGQNPARQSAIKGGLPNSVSAITINDVCGSGLKALHLATQAIQCGEADIVIAGGQENMSRAPHVLTDSRTGAQLGNSQLVDSLVHDGLWDAFNDYHIGVTAENLAREYGISRQLQDAYALSSQQKARAAIDAGRFKDEIVPVMTQSNGQTLVVDTDEQPRTDASAEGLARLNPSFDSLGSVTAGNASSINDGAAAVMMMSEAKARALNLPVLARIRAFASVGVDPALMGIAPVYATRRCLERVGWQLAEVDLIEANEAFAAQALSVGKMLEWDERRVNVNGGAIALGHPIGASGCRILVSLVHEMVKRNARKGLATLCIGGGQGVALTIERDE

SEQ ID NO: 189 - protein, 432 aa, Escherichia coli
MQVSVETTQGLGRRVTITIAADSIETAVKSELVNVAKKVRIDGFRKGKVPMNIVAQRYGASVRQDVLGDLMSRNFIDAIIKEKINPAGAPTYVPGEYKLGEDFTYSVEFEVYPEVELQGLEAIEVEKPIVEVTDADVDGMLDTLRKQQATWKEKDGAVEAEDRVTIDFTGSVDGEEFEGGKASDFVLAMGQGRMIPGFEDGIKGHKAGEEFTIDVTFPEEYHAENLKGKAAKFAINLKKVEERELPELTAEFIKRFGVEDGSVEGLRAEVRKNMERELKSAIRNRVKSQAIEGLVKANDIDVPAALIDSEIDVLRRQAAQRFGGNEKQALELPRELFEEQAKRRVVVGLLLGEVIRTNELKADEERVKGLIEEMASAYEDPKEVIEFYSKNKELMDNMRNVALEEQAVEAVLAKAKVTEKETTFNELMNQQA

SEQ ID NO: 190 - protein, 220 aa, Escherichia coli
MKTKLMTLQDATGFFRDGMTIMVGGFMGIGTPSRLVEALLESGVRDLTLIANDTAFVDTGIGPLIVNGRVRKVIASHIGTNPETGRRMISGEMDVVLVPQGTLIEQIRCGGAGLGGFLTPTGVGTVVEEGKQTLTLDGKTWLLERPLRADLALIRAHRCDTLGNLTYQLSARNFNPLIALAADITLVEPDELVETGELQPDHIVTPGAVIDHIIVSQESK

SEQ ID NO: 191 - protein, 216 aa, Escherichia coli
MDAKQRIARRVAQELRDGDIVNLGIGLPTMVANYLPEGIHITLQSENGFLGLGPVTTAHPDLVNAGGQPCGVLPGAAMFDSAMSFALIRGGHIDACVLGGLQVDEEANLANWVVPGKMVPGMGGAMDLVTGSRKVIIAMEHCAKDGSAKILRRCTMPLTAQHAVHMLVTELAVFRFIDGKMWLTEIADGCDLATVRAKTEARFEVAADLNTQRGDL

SEQ ID NO: 192 - protein, 440 aa, Escherichia coli
MIGRISRFMTRFVSRWLPDPLIFAMLLTLLTFVIALWLTPQTPISMVKMWGDGFWNLLAFGMQMALIIVTGHALASSAPVKSLLRTAASAAKTPVQGVMLVTFFGSVACVINWGFGLVVGAMFAREVARRVPGSDYPLLIACAYIGFLTWGGGFSGSMPLLAATPGNPVEHIAGLIPVGDTLFSGFNIFITVALIVVMPFITRMMMPKPSDVVSIDPKLLMEEADFQKQLPKDAPPSERLEESRILTLIIGALGIAYLAMYFSEHGFNITINTVNLMFMIAGLLLHKTPMAYMRAISAAARSTAGILVQFPFYAGIQLMMEHSGLGGLITEFFINVANKDTFPVMTFFSSALINFAVPSGGGHWVIQGPFVIPAAQALGADLGKSVMAIAYGEQWMNMAQPFWALPALAIAGLGVRDIMGYCITALLFSGVIFVIGLTLF

SEQ ID NO: 193 - protein, 394 aa, Escherichia coli
MKNCVIVSAVRTAIGSFNGSLASTSAIDLGATVIKAAIERAKIDSQHVDEVIMGNVLQAGLGQNPARQALLKSGLAETVCGFTVNKVCGSGLKSVALAAQAIQAGQAQSIVAGGMENMSLAPYLLDAKARSGYRLGDGQVYDVILRDGLMCATHGYHMGITAENVAKEYGITREMQDELALHSQRKAAAAIESGAFTAEIVPVNVVTRKKTFVFSQDEFPKANSTAEALGALRPAFDKAGTVTAGNASGINDGAAALVIMEESAALAAGLTPLARIKSYASGGVPPALMGMGPVPATQKALQLAGLQLADIDLIEANEAFAAQFLAVGKNLGFDSEKVNVNGGAIALGHPIGASGARILVTLLHAMQARDKTLGLATLCIGGGQGIAMVIERLN

SEQ ID NO: 194 - protein, 313 aa, Staphylococcus aureus
MNVGIKGFGAYAPEKIIDNAYFEQFLDTSDEWISKMTGIKERHWADDDQDTSDLAYEASVKAIADAGIQPEDIDMIIVATATGDMPFPTVANMLQERLGTGKVASMDQLAACSGFMYSMITAKQYVQSGDYHNILVVGADKLSKITDLTDRSTAVLFGDGAGAVIIGEVSEGRGIISYEMGSDGTGGKHLYLDKDTGKLKMNGREVFKFAVRIMGDASTRVVEKANLTSDDIDLFIPHQANIRIMESARERLGISKDKMSVSVNKYGNTSAASIPLSIDQELKNGKLKDDDTIVLVGFGGGLTWGAMTIKWGK

SEQ ID NO: 195 - protein, 312 aa, Bacillus subtilis
MKAGILGVGRYIPEKVLTNHDLEKMVETSDEWIRTRTGIEERRIAADDVFSSHMAVAAAKNALEQAEVAAEDLDMILVATVTPDQSFPTVSCMIQEQLGAKKACAMDISAACAGFMYGVVTGKQFIESGTYKHVLVVGVEKLSSITDWEDRNTAVLFGDGAGAAVVGPVSDDRGILSFELGADGTGGQHLYLNEKRHTIMNGREVFKFAVRQMGESCVNVIEKAGLSKEDVDFLIPHQANIRIMEAARERLELPVEKMSKTVHKYGNTSAASIPISLVEELEAGKIKDGDVVVMVGFGGGLTWGAIAIRWGR

SEQ ID NO: 196 - protein, 350 aa, Pseudomonas aeruginosa
MESFNTFVRQYNDQHAEAIAKGELEALAESSSAFIEKASGIKSRFVMNKEGILDPQRMVPYLPERSNDEWSILCEMAVAAAREALQRAGRSAADIDGVIVACSNLQRAYPAIAVEVQAALGIQGYGYDMNVACSSATFGIQAATTAIQTGQARAILMVNPEICTGHLNFRDRDSHFIFGDACTAVIVERADLAVSKHQFDIVSTRLLTQFSNNIRNNFGFLNRADESGIGKRDKLFVQEGRKVFKDVCPMVAELIGEHLAANEIQVAEVKRFWLHQANLNMNLLITRKLLGRDAEAHEAPVILDSYANTSSAGSVIALHKHQDDLPSGAIGVLSSFGAGYSIGSVILRKH

SEQ ID NO: 197 - protein, 335 aa, Mycobacterium tuberculosis
MTEIATTSGARSVGLLSVGAYRPERVVTNDEICQHIDSSDEWIYTRTGIKTRRFAADDESAASMATEACRRALSNAGLSAADIDGVIVTTNTHFLQTPPAAPMVAASLGAKGILGFDLSAGCAGFGYALGAAADMIRGGGAATMLVVGTEKLSPTIDMYDRGNCFIFADGAAAVVVGETPFQGIGPTVAGSDGEQADAIRQDIDWITFAQNPSGPRPFVRLEGPAVFRWAAFKMGDVGRRAMDAAGVRPDQIDVFVPHQANSRINELLVKNLQLRPDAVVANDIEHTGNTSAASIPLAMAELLTTGAAKPGDLALLIGYGAGLSYAAQVVRMPKG

SEQ ID NO: 198 - protein, 343 aa, Rhodothermus marinus; identical to SEQ ID NO: 99

SEQ ID NO: 199 - protein, 343 aa, Streptomyces davawensis; identical to SEQ ID NO: 100

SEQ ID NO: 200 - protein, 331 aa, Chlamydophila pecorum; identical to SEQ ID NO: 101

SEQ ID NO: 201 - protein, 331 aa, Clostridium ultunense; identical to SEQ ID NO: 102

SEQ ID NO: 202 - protein, 333 aa, Corallococcus coralloides; identical to SEQ ID NO: 103

SEQ ID NO: 203 - protein, 334 aa, Desmospora sp.; identical to SEQ ID NO: 104

SEQ ID NO: 204 - protein, 329 aa, Paenibacillus peoriae; identical to SEQ ID NO: 64

SEQ ID NO: 205 - protein, 330 aa, Pelosinus fermentans; identical to SEQ ID NO: 106

SEQ ID NO: 206 - protein, 331 aa, Candidatus Solibacter; identical to SEQ ID NO: 107

SEQ ID NO: 207 - protein, 337 aa, Desulfotomaculum nigrificans; identical to SEQ ID NO: 108

SEQ ID NO: 208 - protein, 323 aa, Saccharomonospora glauca; identical to SEQ ID NO: 109

SEQ ID NO: 209 - protein, 335 aa, Corallococcus coralloides; identical to SEQ ID NO: 110

SEQ ID NO: 210 - protein, 336 aa, Legionella pneumophila; identical to SEQ ID NO: 111

SEQ ID NO: 211 - protein, 330 aa, Streptomyces avermitilis; identical to SEQ ID NO: 112

SEQ ID NO: 212 - protein, 350 aa, Verrucosispora maris; identical to SEQ ID NO: 113

SEQ ID NO: 213 - protein, 392 aa, Rhodopirellula baltica; identical to SEQ ID NO: 114

SEQ ID NO: 214 - protein, 327 aa, Candidatus Methylomirabilis; identical to SEQ ID NO: 115

SEQ ID NO: 215 - protein, 418 aa, Thermaerobacter marianensis; identical to SEQ ID NO: 116

SEQ ID NO: 216 - protein, 326 aa, Caldisericum exile; identical to SEQ ID NO: 117

SEQ ID NO: 217 - protein, 332 aa, Indibacter alkaliphilus; identical to SEQ ID NO: 118

SEQ ID NO: 218 - protein, 331 aa, Candidatus Amoebophilus; identical to SEQ ID NO: 119

SEQ ID NO: 219 - protein, 348 aa, Flavobacterium sp.; identical to SEQ ID NO: 120

SEQ ID NO: 220 - protein, 326 aa, Anaeromyxobacter dehalogenans; identical to SEQ ID NO: 9

SEQ ID NO: 221 - protein, 333 aa, Microcystis aeruginosa; identical to SEQ ID NO: 16

SEQ ID NO: 222 - protein, 342 aa, Chloroflexus aggregans; identical to SEQ ID NO: 20

SEQ ID NO: 223 - protein, 327 aa, Lactobacillus hilgardii; identical to SEQ ID NO: 21

SEQ ID NO: 224 - protein, 324 aa, Bartonella grahamii; identical to SEQ ID NO: 24

SEQ ID NO: 225 - protein, 324 aa, Clostridium botulinum; identical to SEQ ID NO: 25

SEQ ID NO: 226 - protein, 312 aa, Vibrio cholerae; identical to SEQ ID NO: 26

SEQ ID NO: 227 - protein, 332 aa, Propionibacterium acnes; identical to SEQ ID NO: 29

SEQ ID NO: 228 - protein, 333 aa, Streptomyces ghanaensis; identical to SEQ ID NO: 30

SEQ ID NO: 229 - protein, 331 aa, Veillonella sp.; identical to SEQ ID NO: 31

SEQ ID NO: 230 - protein, 343 aa, Streptomyces sp.; identical to SEQ ID NO: 33

SEQ ID NO: 231 - protein, 307 aa, Streptomyces sp.; identical to SEQ ID NO: 37

SEQ ID NO: 232 - protein, 307 aa, uncultured Aquificae; identical to SEQ ID NO: 55

SEQ ID NO: 233 - protein, 326 aa, Saccharomonospora azurea; identical to SEQ ID NO: 57

SEQ ID NO: 234 - protein, 373 aa, Ralstonia solanacearum; identical to SEQ ID NO: 63

SEQ ID NO: 235 - protein, 307 aa, Frankia sp.; identical to SEQ ID NO: 65

SEQ ID NO: 236 - protein, 372 aa, Alishewanella aestuarii; identical to SEQ ID NO: 66

SEQ ID NO: 237 - protein, 342 aa, Brevibacillus sp.; identical to SEQ ID NO: 69

SEQ ID NO: 238 - protein, 323 aa, Sphingomonas sp.; identical to SEQ ID NO: 73

SEQ ID NO: 239 - protein, 374 aa, Alteromonas macleodii; identical to SEQ ID NO: 74

SEQ ID NO: 240 - protein, 341 aa, Leptospirillum ferriphilum; identical to SEQ ID NO: 75

SEQ ID NO: 241 - protein, 319 aa, Glaciecola polaris; identical to SEQ ID NO: 76

SEQ ID NO: 242 - protein, 287 aa, Listeria monocytogenes; identical to SEQ ID NO: 79

SEQ ID NO: 243 - protein, 335 aa, Mycobacterium avium; identical to SEQ ID NO: 81

SEQ ID NO: 244 - protein, 328 aa, Fusobacterium nucleatum; identical to SEQ ID NO: 85

SEQ ID NO: 245 - protein, 362 aa, Mycobacterium liflandii; identical to SEQ ID NO: 93

SEQ ID NO: 246 - protein, 373 aa, Mesorhizobium sp.; identical to SEQ ID NO: 96

SEQ ID NO: 247 - protein, 316 aa, Streptomyces coelicolor; identical to SEQ ID NO: 4

SEQ ID NO: 248 - protein, 320 aa, Clostridiales bacterium; identical to SEQ ID NO: 23

SEQ ID NO: 249 - protein, 323 aa, Ruegeria sp.; identical to SEQ ID NO: 27

SEQ ID NO: 250 - protein, 341 aa, Rothia dentocariosa; identical to SEQ ID NO: 35

SEQ ID NO: 251 - protein, 328 aa, Caldicellulosiruptor kristjanssonii; identical to SEQ ID NO: 36

SEQ ID NO: 252 - protein, 322 aa, Thermus scotoductus; identical to SEQ ID NO: 39

SEQ ID NO: 253 - protein, 326 aa, Geobacter sp.; identical to SEQ ID NO: 40

SEQ ID NO: 254 - protein, 345 aa, Rhodococcus equi; identical to SEQ ID NO: 42

SEQ ID NO: 255 - protein, 332 aa, Clostridium papyrosolvens; identical to SEQ ID NO: 44

SEQ ID NO: 256 - protein, 334 aa, Cellulomonas fimi; identical to SEQ ID NO: 45

SEQ ID NO: 257 - protein, 320 aa, Neisseria macacae; identical to SEQ ID NO: 48

SEQ ID NO: 258 - protein, 346 aa, Rhodothermus marinus; identical to SEQ ID NO: 50

SEQ ID NO: 259 - protein, 323 aa, Gluconacetobacter oboediens; identical to SEQ ID NO: 51

SEQ ID NO: 260 - protein, 373 aa, Halomonas sp.; identical to SEQ ID NO: 52

SEQ ID NO: 261 - protein, 340 aa, Saccharomonospora cyanea; identical to SEQ ID NO: 56

SEQ ID NO: 262 - protein, 333 aa, Arcobacter butzleri; identical to SEQ ID NO: 59

SEQ ID NO: 263 - protein, 373 aa, Marinobacter adhaerens; identical to SEQ ID NO: 61

SEQ ID NO: 264 - protein, 374 aa, Phaeobacter gallaeciensis; identical to SEQ ID NO: 70

SEQ ID NO: 265 - protein, 373 aa, Aeromonas hydrophila; identical to SEQ ID NO: 87

SEQ ID NO: 266 - protein, 339 aa, Rhodococcus opacus; identical to SEQ ID NO: 89

SEQ ID NO: 267 - protein, 356 aa, Gordonia aichiensis; identical to SEQ ID NO: 91

SEQ ID NO: 268 - protein, 368 aa, Acinetobacter sp.; identical to SEQ ID NO: 98

SEQ ID NO: 269 - protein, 247 aa, Pseudomonas aeruginosa
MSLQGKVALVTGASRGIGQAIALELGRLGAVVIGTATSASGAEKIAETLKANGVEGAGLVLDVSSDESVAATLEHIQQHLGQPLIVVNNAGITRDNLLVRMKDDEWFDVVNTNLNSLYRLSKAVLRGMTKARWGRIINIGSVVGAMGNAGQTNYAAAKAGLEGFTRALAREVGSRAITVNAVAPGFIDTDMTRELPEAQREALLGQIPLGRLGQAEEIAKVVGFLASDGAAYVTGATVPVNGGMYMS

SEQ ID NO: 270 - protein, 247 aa, Pseudomonas aeruginosa
MSLQGKVALVTGASRGIGQAIALELGRLGAVVIGTATSASGAEKIAETLKANGVEGAGLVLDVSSDESVAATLEHIQQHLGQPLIVVNNAGITRDNLLVRMKDDEWFDVVNTNLNSLYRLSKAVLRGMTKARWGRIINIGSVVGAMGNAGQTNYAAAKAGLEGFTRALAREVGSRAITVNAVAPGFIDTDMTRELPEAQREALLAQIPLGRLGQAEEIAKVVGFLASDGAAYVTGATVPVNGGMYMS

SEQ ID NO: 271 - protein, 282 aa, Clostridium beijerinckii
MKKIFVLGAGTMGAGIVQAFAQKGCEVIVRDIKEEFVDRGIAGITKGLEKQVAKGKMSEEDKEAILSRISGTTDMKLAADCDLVVEAAIENMKIKKEIFAELDGICKPEAILASNTSSLSITEVASATKRPDKVIGMHFFNPAPVMKLVEIIKGIATSQETFDAVKELSVAIGKEPVEVAEAPGFVVNGILIPMINEASFILQEGIASVEDIDTAMKYGANHPMGPLALGDLIGLDVCLAIMDVLFTETGDNKYRASSILRKYVRAGWLGRKSGKGFYDYSK

SEQ ID NO: 272 - protein, 261 aa, Clostridium acetobutylicum
MELNNVILEKEGKVAVVTINRPKALNALNSDTLKEMDYVIGEIENDSEVLAVILTGAGEKSFVAGADISEMKEMNTIEGRKFGILGNKVFRRLELLEKPVIAAVNGFALGGGCEIAMSCDIRIASSNARFGQPEVGLGITPGFGGTQRLSRLVGMGMAKQLIFTAQNIKADEALRIGLVNKVVEPSELMNTAKEIANKIVSNAPVAVKLSKQAINRGMQCDIDTALAFESEAFGECFSTEDQKDAMTAFIEKRKIEGFKNR

SEQ ID NO: 273 - protein, 355 aa, Pseudomonas putida
MSDTEVPVLAEVRNRVGHLALNRPVGLNALTLQMIRITWRQLHAWESDPEIVAVVLRANGEKAFCAGGDIRSLYDSYQAGDDLHHVFLEEKYSLDQYIHGYPKPIVALMDGFVLGGGMGLVQGTALRVVTERVKMGMPETSIGYFPDVGGSYFLPRLPGELGLYLGITGIQIRAADALYARLADWCLPSERISEFDRRLDQISWGYAPREILAGLLSSLASNRLLGAELKSLHPAIDEHFTQPDLSAIRASLQAERRPEYQDWAEQTVELLNNRSPLAMSATLKLLRLGRTLSLANCFELELHLERQWFAKGDLIEGVRALLIDKDKTPRWNPPTLEQLDTNRVNEFFDGFQPAT

SEQ ID NO: 274 - protein, 735 aa, Rattus norvegicus
MASPLRFDGRVVLVTGAGGGLGRAYALAFAERGALVVVNDLGGDFKGVGKGSSAADKVVEEIRRRGGKAVANYDSVEAGEKLVKTALDTFGRIDVVVNNAGILRDRSFSRISDEDWDIIQRVHLRGSFQVTRAAWDHMKKQNYGRIIMTASASGIYGNFGQANYSAAKLGLLGLANTLVIEGRKNNIHCNTIAPNAGSRMTETVMPEDLVEALKPEYVAPLVLWLCHESCEENGGLFEVGAGWIGKLRWERTLGAIVRKRNQPMTPEAVRDNWVKICDFSNASKPKSIQESTGGIIEVLHKIDSEGISQNHTGQVASADASGFAGVVGHKLPSFSSSYTELQCIMYALGVGASVKNPKDLKFVYEGSADFSCLPTFGVIVAQKSLMSGGLAEVPGLSINFAKVLHGEQYLELYKPLPRSGELKCEAVIADILDKGSGIVIVMDVYSYSGKELICYNQFSVFVVGSGGFGGKRTSEKLKAAVAVPSRPPDAVLRDTTSLNQAALYRLSGDSNPLHIDPSFASIAGFEKPILHGLCTFGFSARHVLQQFADNDVSRFKAIKVRFAKPVYPGQTLQTEMWKEGNRIHFQTKVQETGDIVISNAYVDLVPTSGVSAQTPSEGGALQSALVFGEIGRRLKDVGREVVKKVNAVFEWHITKNGNVAAKWTIDLKNGSGEVYQGPAKGSADTTITISDEDFMEVVLGKLNPQNAFFSGRLKARGNIMLSQKLQMILKDYAKL

SEQ ID NO: 275 - protein, 397 aa, Treponema denticola
MIVKPMVRNNICLNAHPQGCKKGVEDQIEYTKKRITAEVKAGAKAPKNVLVLGCSNGYGLASRITAAFGYGAATIGVSFEKAGSETKYGTPGWYNNLAFDEAAKREGLYSVTIDGDAFSDEIKAQVIEEAKKKGIKFDLIVYSLASPVRTDPDTGIMHKSVLKPFGKTFTGKTVDPFTGELKEISAEPANDEEAAATVKVMGGEDWERWIKQLSKEGLLEEGCITLAYSYIGPEATQALYRKGTIGKAKEHLEATAHRLNKENPSIRAFVSVNKGLVTRASAVIPVIPLYLASLFKVMKEKGNHEGCIEQITRLYAERLYRKDGTIPVDEENRIRIDDWELEEDVQKAVSALMEKVTGENAESLTDLAGYRHDFLASNGFDVEGINYEAEVERFDRI

SEQ ID NO: 276 - protein, 447 aa, Streptomyces collinus
MTVKDILDAIQSKDATSADFAALQLPESYRAITVHKDETEMFAGLETRDKDPRKSIHLDEVPVPELGPGEALVAVMASSVNYNSVWTSIFEPVSTFAFLERYGKLSPLTKRHDLPYHIIGSDLAGVVLRTGPGVNAWQPGDEVVAHCLSVELESPDGHDDTMLDPEQRIWGFETNFGGLAEIALVKTNQLMPKPKHLTWEEAAAPGLVNSTAYRQLVSRNGAAMKQGDNVLIWGASGGLGSYATQFALAGGANPICVVSSPQKAEICRSMGAEAIIDRNAEGYKFWKDEHTQDPKEWKRFGKRIRELTGGEDIDIVFEHPGRETFGASVYVTRKGGTITTCASTSGYMHEYDNRYLWMSLKRIIGSHFANYREAYEANRLIAKGKIHPTLSKTYSLEETGQAAYDVHRNLHQGKVGVLCLAPEEGLGVRDAEMRAQHIDAINRFRNV

SEQ ID NO: 277 - protein, 208 aa, Escherichia coli
MMNFNNVFRWHLPFLFLVLLTFRAAAADTLLILGDSLSAGYRMSASAAWPALLNDKWQSKTSVVNASISGDTSQQGLARLPALLKQHQPRWVLVELGGNDGLRGFQPQQTEQTLRQILQDVKAANAEPLLMQIRLPANYGRRYNEAFSAIYPKLAKEFDVPLLPFFMEEVYLKPQWMQDDGIHPNRDAQPFIADWMAKQLQPLVNHDS

SEQ ID NO: 278 - protein, 183 aa, Escherichia coli
AADTLLILGDSLSAGYRMSASAAWPALLNDKWQSKTSVVNASISGDTSQQGLARLPALLKQHQPRWVLVELGGNDGLRGFQPQQTEQTLRQILQDVKAANAEPLLMQIRLPANYGRRYNEAFSAIYPKLAKEFDVPLLPFFMEEVYLKPQWMQDDGIHPNRDAQPFIADWMAKQLQPLVNHDS

SEQ ID NO: 279 - protein, 286 aa, Escherichia coli
MSQALKNLLTLLNLEKIEEGLFRGQSEDLGLRQVFGGQVVGQALYAAKETVPEERLVHSFHSYFLRPGDSKKPIIYDVETLRDGNSFSARRVAAIQNGKPIFYMTASFQAPEAGFEHQKTMPSAPAPDGLPSETQIAQSLAHLLPPVLKDKFICDRPLEVRPVEFHNPLKGHVAEPHRQVWIRANGSVPDDLRVHQYLLGYASDLNFLPVALQPHGIGFLEPGIQIATIDHSMWFHRPFNLNEWLLYSVESTSASSARGFVRGEFYTQDGVLVASTVQEGVMRNHN

SEQ ID NO: 280 - protein, 132 aa, Escherichia coli
MSTTHNVPQGDLVLRTLAMPADTNANGDIFGGWLMSQMDIGGAILAKEIAHGRVVTVRVEGMTFLRPVAVGDVVCCYARCVQKGTTSVSINIEVWVKKVASEPIGQRYKATEALFKYVAVDPEGKPRALPVE

SEQ ID NO: 281 - protein, 134 aa, Escherichia coli
MNTTLFRWPVRVYYEDTDAGGVVYHASYVAFYERARTEMLRHHHFSQQALMAERVAFVVRKMTVEYYAPARLDDMLEIQTEITSMRGTSLVFTQRIVNAENTLLNEAEVLVVCVDPLKMKPRALPKSIVAEFKQ

SEQ ID NO: 282 - protein, 254 aa, Escherichia coli
MKLNIRAQTAQNQHNNSPIVLVHGLFGSLDNLGVLARDLVNDHNIIQVDMRNHGLSPRDPVMNYPAMAQDLVDTLDAQQIDKATFIGHSMGGKAVMALTALASDRIDKLVAIDIAPVDYHVRRHDEIFAAINAVSESDAQTRQQAAAIMRQHLNEEGVIQFLLKSFVDGEWRFNVPVLWDQYPHIVGWEKIPAWDHPALFIPGGNSPYVSEQYRDDLLAQFPQARAHVIAGAGHWVHAEKPDAVLRAIRRYLND

SEQ ID NO: 283 - protein, 132 aa, Escherichia coli
MQTQIKVRGYHLDVYQHVNNARYLEFLEEARWDGLENSDSFQWMTAHNIAFVVVNININYRRPAVLSDLLTITSQLQQLNGKSGILSQVITLEPEGQVVADALITFVCIDLKTQKALALEGELREKLEQMVK

SEQ ID NO: 284 - protein, 231 aa, Anaerococcus tetradius
MKFKKKFKIGRMHVDPFNYISMRYLVALMNEVAFDQAEILEKDIDMKNLRWIIYSWDIQIENNIRLGEEIEITTIPTHMDKFYAYRDFIVESRGNILARAKATFLLMDITRLRPIKIPQNLSLAYGKENPIFDIYDMEIRNDLAFIRDIQLRRADLDNNFHINNAVYFDLIKETVDIYDKDISYIKLIYRNEIRDKKQIQAFARREDKSIDFALRGEDGRDYCLGKIKTNV

SEQ ID NO: 285 - protein, 411 aa, Cuphea palustris
MVAAAASSACFPVPSPGASPKPGKLGNWSSSLSPSLKPKSIPNGGFQVKANASAHPKANGSAVTLKSGSLNTQEDTLSSSPPPRAFFNQLPDWSMLLTAITTVFVAPEKRWTMFDRKSKRPNMLMDSFGLERVVQDGLVFRQSFSIRSYEICADRTASIETVMNHVQETSLNQCKSIGLLDDGFGRSPEMCKRDLIWVVTRMKIMVNRYPTWGDTIEVSTWLSQSGKIGMGRDWLISDCNTGEILVRATSVYAMMNQKTRRFSKLPHEVRQEFAPHFLDSPPAIEDNDGKLQKFDVKTGDSIRKGLTPGWYDLDVNQHVSNVKYIGWILESMPTEVLETQELCSLTLEYRRECGRDSVLESVTSMDPSKVGDRFQYRHLLRLEDGADIMKGRTEWRPKNAGTNGAISTGKT

SEQ ID NO: 286 - protein, 246 aa, Clostridium perfringens
MGKAYEKVYEVTYGETDGRKDCRITSMMNFFSDCCLSQEEKNSMNYADNSSETTWVFFDYEIIVNRYPRYREKIKVKTYVESIRKFYSNRVFEAYDMDGALVARADVLAFLINKKTRRPARISDEEYEIHGLSKESSKLLRKKLNFEKFDKEDLEMNFHIRYLDIDLNMHVSNIKYVEWILETVPVDIVLNYKMKKIKIKFEKEITYGHNVIIKSKIIKGEDEVKVLHKVENEEGESITLAETYWY

SEQ ID NO: 287 - protein, 261 aa, Lactobacillus plantarum
MATLGANASLYSEQHRITYYECDRTGRATLTTLIDIAVLASEDQSDALGLTTEMVQSHGVGWVVTQYAIDITRMPRQDEVVTIAVRGSAYNPYFAYREFWIRDADGQQLAYITSIWVMMSQTTRRIVKILPELVAPYQSEVVKRIPRLPRPISFEATDTTITKPYHVRFFDIDPNRHVNNAHYFDWLVDTLPATFLLQHDLVHVDVRYENEVKYGQTVTAHANILPSEVADQVTTSHLIEVDDEKCCEVTIQWRTLPEPIQ

SEQ ID NO: 288 - protein, 134 aa, Pseudomonas aeruginosa
MADRQLLHTAHIPVRWGDMDSYGHVNNTLYFQYLEEARVAWFETLGIDLEGAAEGPVVLQSLHTYLKPVVHPATVVVELYAGRLGTSSLVLEHRLHTLEDPQGTYGEGHCKLVWVRHAENRSTPVPDSIRAAIA

SEQ ID NO: 289 - protein, 455 aa, Marinobacter aquaeolei
MTPLNPTDQLFLWLEKRQQPMHVGGLQLFSFPEGAPDDYVAQLADQLRQKTEVTAPFNQRLSYRLGQPVWVEDEHLDLEHHFRFEALPTPGRIRELLSFVSAEHSHLMDRERPMWEVHLIEGLKDRQFALYTKVHHSLVDGVSAMRMATRMLSENPDEHGMPPIWDLPCLSRDRGESDGHSLWRSVTHLLGLSGRQLGTIPTVAKELLKTINQARKDPAYDSIFHAPRCMLNQKITGSRRFAAQSWCLKRIRAVCEAYGTTVNDVVTAMCAAALRTYLMNQDALPEKPLVAFVPVSLRRDDSSGGNQVGVILASLHTDVQEAGERLLKIHHGMEEAKQRYRHMSPEEIVNYTALTLAPAAFHLLTGLAPKWQTFNVVISNVPGPSRPLYWNGAKLEGMYPVSIDMDRLALNMTLTSYNDQVEFGLIGCRRTLPSLQRMLDYLEQGLAELELNAGL

SEQ ID NO: 290 - protein, 479 aa, Psychrobacter cryohalolentis
MRLLTAVDQLFLLLESRKQPMHVGGLFLFELPEDADISFVHQLVKQMQDSHVPPTFPFNQVLEHMVFWKKDKNFDVEHHLHHVALPKPARVRELLMYVSREHGRLLDRAMPLWECHVIEGIQPESEGSPERFALYFKIHHSLVDGIAAMRLVKKSLSQSPNEPVTLPIWSLMARHRNQIDAILPKERSALRILKEQVSTIKPVFTELLDNFKNYNDDSYVSTFDAPRSILNRRISASRRIAAQSYDIKRFNDIAERINISKNDVVLAVCAGAIRRYLISMDALPSKPLIAFVPMSLRTDDSVAGNQLSFVLANLGTHLDDPLSRIKLIHRSMNNGKRRFRRMNQAQVINYSVVSYAWEGINLATGLFPKKQAFNLIISNVPGSEKSLYWNGARLQSLYPASIVFNGQAMNITLASYLDKIEFGITACSKALPHVQDMLMLIEEELQLLEKVSKELEFNGITVEDKSGYKGNGKTKKLAP

SEQ ID NO: 291 - protein, 453 aa, Rhodococcus jostii
MPVTDSIFLLGESREHPMHVGSLELFTPPEDAGPDYVKSMHETLLEHTDVDPAFRKKPAGPVGSLGNLWWADESDVDLEYHVRHSALPAPYRVRELLTLTSRLHGTLLDRHRPLWEMYLIEGLSDGRFAIYTKLHHSLMDGVSGLRLLMRTLSTDPDVRDAPPPWNLPRRASANGAAPAPDLWSVMNGVRRTVGEVAGLAPASLRIARTAMGQHDMRFPYEAPRTMLNVPIGGARRFAAQSWPLERVHAVRKVAGVSVNDVVMAMCAGALRGYLEEQNALPDEPLIAMVPVSLRDEQQADAGGNAVGVTLCNLATDVDDPAERLTAISASMSQGKELFGSLTSMQALAWSAVNMSPIALTPVPGFVRFTPPPFNVIISNVPGPRKTMYWNGSRLDGIYPTSVVLDGQALNITLTTNGGNLDFGVIGCRRSVPSLQRILFYLETALGELEAALL

SEQ ID NO: 292 - protein, 457 aa, Alcanivorax borkumensis
MKALSPVDQLFLWLEKRQQPMHVGGLQLFSFPEGAGPKYVSELAQQMRDYCHPVAPFNQRLTRRLGQYYWTRDKQFDIDHHFRHEALPKPGRIRELLSLVSAEHSNLLDRERPMWEAHLIEGIRGRQFALYYKIHHSVMDGISAMRIASKTLSTDPSEREMAPAWAFNTKKRSRSLPSNPVDMASSMARLTASISKQAATVPGLAREVYKVTQKAKKDENYVSIFQAPDTILNNTITGSRRFAAQSFPLPRLKVIAKAYNCTINTVVLSMCGHALREYLISQHALPDEPLIAMVPMSLRQDDSTGGNQIGMILANLGTHICDPANRLRVIHDSVEEAKSRFSQMSPEEILNFTALTMAPTGLNLLTGLAPKWRAFNVVISNIPGPKEPLYWNGAQLQGVYPVSIALDRIALNITLTSYVDQMEFGLIACRRTLPSMQRLLDYLEQSIRELEIGAGIK

SEQ ID NO: 293 - protein, 628 aa, Salmonella enterica
MSFSEFYQRSINEPEAFWAEQARRIDWRQPFTQTLDHSRPPFARWFCGGTTNLCHNAVDRWRDKQPEALALIAVSSETDEERTFTFSQLHDEVNAVAAMLLSLGVQRGDRVLVYMPMIAEAQITLLACARIGAIHSVVFGGFASHSVAARIDDARPALIVSADAGARGGKILPYKKLLDDAIAQAQHQPKHVLLVDRGLAKMSWVDGRDLDFSTLRQQYLGASVPVAWLESNETSCILYTSGTTGKPKGVQRDVGGYAVALATSMDTIFGGKAGGVFFCASDIGWVVGHSYIVYAPLLAGMATIVYEGLPTYPDCGVWWKIVEKYQVNRMFSAPTAIRVLKKFPTAQIRNHDLSSLEALYLAGEPLDEPTASWVTETLGVPVIDNYWQTESGWPIMALARALDDRPSRLGSPGVPMYGYNVQLLNEVTGEPCGINEKGMLVIEGPLPPGCIQTIWGDDARFVKTYWSLFNRQVYATFDWGIRDAEGYYFILGRTDDVINIAGHRLGTREIEESISGYPNVAEVAVVGIKDALKGQVAVAFVIPKQSDTLADREAARDEEKAIMALVDNQIGHFGRPAHVWFVSQLPKTRSGKMLRRTIQAICEGRDPGDLTTIDDPASLQQIRQAIEE

SEQ ID NO: 294 - protein, 388 aa, Rhodobacter sphaeroides
MVIVSAARTAVGSFNGAFASTPAHDLGAAVIEAVVARAGIDKADVSETILGQVLTAGQGQNPARQAHIKAGLPQESAAWSINQVCGSGLRAVALAAQHVQLGDASIVVAGGQENMSLSPHVAHLRAGQKMGDLSFIDSMIKDGLWDAFNGYHMGQTAENVAAKWQISRDMQDEFAVASQNKAEAAQKAGRFADEIVPFVIKTRKGDVTVDADEYIRHGATLDAMAKLRPAFIKDGTVTAANASGINDGAAAVLVMSAEEAEKRGLSPLARIASYATAGLDPSIMGVGPIHASRKALEKAGWKVGDLDLVEANEAFAAQACAVNKDMGWDPSIVNVNGGAIAIGHPIGASGARVLNTLLFEMQRRNAKKGLATLCIGGGMGVAMCLERP

SEQ ID NO: 295 - protein, 240 aa, Rhodobacter sphaeroides
MSKVALVTGGSRGIGAAISVALKNAGYTVAANYAGNDEAARKFTEETGIKTYKWSVADYDACAAGIAQVEAELGPVAVLVNNAGITRDSMFHKMTRDQWKEVIDTNLSGLFNMTHPVWSGMRDRKFGRIINISSINGQKGQAGQANYSAAKAGDLGFTKALAQEGARAGITVNAICPGYIATEMVMAVPEKVRESIIAQIPTGRLGEPEEIARCVVFLASDDAGFVTGSTITANGGQYFV

SEQ ID NO: 296 - protein, 559 aa, Pseudomonas stutzeri
MSDKNNEDLKRQASENTLGLNPVIGIRGKDLLTSARMVLAQALKQPFHSAKHVAHFGLELKNVVFGQSELKPEDGDRRFADPAWSQNPLYRRYLQTYLAWRKELHDWIEHSSLSEQDASRGHFVINLMTEAMAPSNSMANPAAVKRFFETGGKSLLDGMSHLAKDMINNGGMPSQVNMAAFEVGKNLATTEGAVVFRNDVLELIQYKPITESVHERPLLVVPPQINKFYVFDLSPDKSLARFLLRSQVQTFVVSWRNPTKAQREWGLSTYIAALKEAIEVICAITGSKDVNMLGACSGGLTTASLLGHYAALGEQKVHALTLLVSVLDTQLDTQVALFADEKTLEAAKRRSYQAGVLEGSDMAKVFAWMRPNDLIWNYWVNNYLLGNEPPVFDILYWNNDTTRLPAALHGEFIEMFQTNPLTRPGALEVCGTPIDLKQVTCDFFCVAGTTDHITPWDSCYKSAHLFGGKCEFVLSNSGHIQSILNPPGNPKARYMTNSEMPADPKAWQESSTKHADSWWLHWQSWLAERSGKTKNAPTALGNKKFPAGEAAPGTYVHER

SEQ ID NO: 297 - protein, 559 aa, Pseudomonas oleovorans
MSNKNNDELQRQASENTLGLNPVIGIRRKDLLSSARTVLRQAVRQPLHSAKHVAHFGLELKNVLLGKSSLAPESDDRRFNDPAWSNNPLYRRYLQTYLAWRKELQDWIGNSDLSPQDISRGQFVINLMTEAMAPTNTLSNPAAVKRFFETGGKSLLDGLSNLAKDLVNNGGMPSQVNMDAFEVGKNLGTSEGAVVYRNDVLELIQYKPITEQVHARPLLVVPPQINKFYVFDLSPEKSLARYCLRSQQQTFIISWRNPTKAQREWGLSTYIDALKEAVDAVLAITGSKDLNMLGACSGGITCTALVGHYAALGENKVNALTLLVSVLDTTMDNQVALFVDEQTLEAAKRHSYQAGVLEGSEMAKVFAWMRPNDLIWNYWVNNYLLGNEPPVFDILFWNNDTTRLPAAFHGDLIEMFKSNPLTRPDALEVCGTPIDLKQVKCDIYSLAGTNDHITPWQSCYRSAHLFGGKIEFVLSNSGHIQSILNPPGNPKARFMTGADRPGDPVAWQENATKHADSWWLHWQSWLGERAGELEKAPTRLGNRAYAAGEASPGTYVHER

SEQ ID NO: 298 - protein, 559 aa, Pseudomonas aeruginosa
MSQKNNNELPKQAAENTLNLNPVIGIRGKDLLTSARMVLLQAVRQPLHSARHVAHFSLELKNVLLGQSELRPGDDDRRFSDPAWSQNPLYKRYMQTYLAWRKELHSWISHSDLSPQDISRGQFVINLLTEAMSPTNSLSNPAAVKRFFETGGKSLLDGLGHLAKDLVNNGGMPSQVDMDAFEVGKNLATTEGAVVFRNDVLELIQYRPITESVHERPLLVVPPQINKFYVFDLSPDKSLARFCLRNGVQTFIVSWRNPTKSQREWGLTTYIEALKEAIEVVLSITGSKDLNLLGACSGGITTATLVGHYVASGEKKVNAFTQLVSVLDFELNTQVALFADEKTLEAAKRRSYQSGVLEGKDMAKVFAWMRPNDLIWNYWVNNYLLGNQPPAFDILYWNNDTTRLPAALHGEFVELFKSNPLNRPGALEVSGTPIDLKQVTCDFYCVAGLNDHITPWESCYKSARLLGGKCEFILSNSGHIQSILNPPGNPKARFMTNPELPAEPKAWLEQAGKHADSWWLHWQQWLAERSGKTRKAPASLGNKTYPAGEAAPGTYVHER

SEQ ID NO: 299 - protein, 4 aa, Unknown
  Description of Unknown: 3-ketoacyl-CoA synthase peptide motif
PDRP

SEQ ID NO: 300 - protein, 4 aa, Unknown
  Description of Unknown: 3-ketoacyl-CoA synthase peptide motif
HFLQ

SEQ ID NO: 301 - protein, 5 aa, Unknown
  Description of Unknown: 3-ketoacyl-CoA synthase peptide motif
  MOD_RES (1)..(1): Ala or Gly
XGGSR

SEQ ID NO: 302 - protein, 7 aa, Unknown
  Description of Unknown: 3-ketoacyl-CoA synthase peptide motif
  MOD_RES (5)..(5): Any amino acid
STPDXPQ

SEQ ID NO: 303 - protein, 33 aa, Streptomyces sp.
GGLTDLIRVPAGGSRQPLDTDGLDAGLQYFAMD

SEQ ID NO: 304 - protein, 6 aa, Artificial Sequence
  Description of Artificial Sequence: Synthetic 6xHis tag
HHHHHH

What is claimed is:

1. A genetically modified organism comprising:
   a heterologous nucleic acid encoding a first NphT7 polypeptide; and
   a heterologous nucleic acid encoding a second NphT7 polypeptide, the second NphT7 polypeptide comprising one or more amino acid substitutions at a position selected from the group consisting of Ser84, Thr85, Gln90, Val114, Tyr144, Ile147, Val157, Phe159, Ile194, Val196, Phe217, Gly288, and Gly318,
   wherein said microorganism produces a fatty acid or fatty acid-derived product having a carbon chain length of C6 or greater.

2. The genetically modified organism of claim 1 wherein the second NphT7 polypeptide comprises amino acid substitutions at Ile147 and Phe217.

3. The genetically modified organism of claim 1 wherein the second NphT7 polypeptide comprises amino acid substitutions of I147S and F217V.

4. The genetically modified organism of claim 1, wherein the fatty acid or fatty acid-derived product has a carbon chain length of C8 or greater.

5. The genetically modified organism of claim 1, wherein the fatty acid or fatty acid-derived product has a carbon chain length of C10 or greater.

6. The genetically modified organism of claim 1, wherein the microorganism further comprises:
   a heterologous nucleic acid encoding a ketoacyl-CoA reductase;
   a heterologous nucleic acid encoding a hydroxyacyl-CoA dehydratase; and
   a heterologous nucleic acid encoding an enoyl-CoA reductase.

7. The genetically modified organism of claim 6, wherein:
   the ketoacyl-CoA reductase is selected from the group consisting of SEQ ID NO: 183 and SEQ ID NO: 137;
   the hydroxyacyl-CoA dehydratase is selected from the group consisting of SEQ ID NO: 183, SEQ ID NO: 273, and SEQ ID NO: 274; and
   the enoyl-CoA reductase is SEQ ID NO: 275.

8. The genetically modified organism of claim 1 further comprising a heterologous nucleic acid encoding a polypeptide selected from the group consisting of SEQ ID NO: 3-120.

9. The genetically modified organism of claim 1 further comprising a heterologous nucleic acid sequence encoding a termination enzyme that catalyzes production of the fatty acid-derived product selected from the group comprising a fatty alcohol, a fatty aldehyde, a fatty alkene, a fatty amide, a fatty ester, a fatty alkane, and a fatty diacid.

10. The genetically modified organism of claim 9, wherein:
the termination enzyme comprises a wax ester synthase; and
the fatty acid-derived product is a fatty acid ester.

11. The genetically modified organism of claim 10, wherein the wax ester synthase comprises an amino acid sequence of at least 70% homology to any one of SEQ ID NO 289, SEQ ID NO 290, SEQ ID NO 291, and SEQ ID NO 292.

12. The genetically modified organism of claim 10 wherein the second NphT7 polypeptide comprises amino acid substitutions at Ile147 and Phe217.

13. The genetically modified organism of claim 10 wherein the second NphT7 polypeptide comprises amino acid substitutions of I147S and F217V.

14. The genetically modified organism of claim 10, wherein the fatty acid ester has a carbon chain length of C8 or greater.

15. The genetically modified organism of claim 10, wherein the fatty acid ester has a carbon chain length of C10 or greater.

16. The genetically modified organism of claim 10, wherein the microorganism further comprises:
a heterologous nucleic acid encoding a ketoacyl-CoA reductase;
a heterologous nucleic acid encoding a hydroxyacyl-CoA dehydratase; and
a heterologous nucleic acid encoding an enoyl-CoA reductase.

17. The genetically modified organism of claim 16, wherein:
the ketoacyl-CoA reductase is selected from the group consisting of SEQ ID NO: 183 and SEQ ID NO: 137;
the hydroxyacyl-CoA dehydratase is selected from the group consisting of SEQ ID NO: 183, SEQ ID NO: 273, and SEQ ID NO: 274; and
the enoyl-CoA reductase is SEQ ID NO: 275.

18. The genetically modified organism of claim 10 further comprising a heterologous nucleic acid encoding a polypeptide selected from the group consisting of SEQ ID NO: 3-120.

* * * * *